(12) United States Patent
O'Shea et al.

(10) Patent No.: US 10,821,141 B2
(45) Date of Patent: Nov. 3, 2020

(54) HSV-1 ONCOLYTIC VIRUS THERAPIES THAT SPECIFICALLY KILL ALT DEPENDENT CANCERS

(71) Applicant: Salk Institute for Biological Studies, La Jolla, CA (US)

(72) Inventors: Clodagh O'Shea, San Diego, CA (US); Jason DeHart, San Diego, CA (US)

(73) Assignee: Salk Institute for Biological Studies, La Jolla, CA (US)

( * ) Notice: Subject to any disclaimer, the term of this patent is extended or adjusted under 35 U.S.C. 154(b) by 0 days.

(21) Appl. No.: 16/169,421

(22) Filed: Oct. 24, 2018

(65) Prior Publication Data
US 2019/0046594 A1 Feb. 14, 2019

Related U.S. Application Data

(63) Continuation of application No. PCT/US2017/029683, filed on Apr. 26, 2017.

(60) Provisional application No. 62/327,596, filed on Apr. 26, 2016.

(51) Int. Cl.
| | |
|---|---|
| A61K 35/763 | (2015.01) |
| A61K 38/19 | (2006.01) |
| C12N 15/86 | (2006.01) |
| A61P 35/00 | (2006.01) |
| C12N 15/63 | (2006.01) |
| C07K 14/005 | (2006.01) |
| A61K 45/06 | (2006.01) |

(52) U.S. Cl.
CPC .......... *A61K 35/763* (2013.01); *A61K 38/193* (2013.01); *A61P 35/00* (2018.01); *C12N 15/63* (2013.01); *C12N 15/86* (2013.01); *A61K 45/06* (2013.01); *C07K 14/005* (2013.01); *C12N 2710/16621* (2013.01); *C12N 2710/16622* (2013.01); *C12N 2710/16632* (2013.01); *C12N 2740/15041* (2013.01)

(58) Field of Classification Search
CPC .................. A61K 35/763; A61K 39/12; A61K 2039/5254; A61K 2039/55; A61K 39/245; A61K 9/0019; C07K 14/005; C07K 2317/73; C12N 15/63; C12N 15/86; C12N 2710/16621; C12N 2710/16622; C12N 2710/16632; C12N 2740/15041; A61P 35/00; G01N 2800/52
See application file for complete search history.

(56) References Cited

U.S. PATENT DOCUMENTS

| | | | |
|---|---|---|---|
| 5,393,870 A * | 2/1995 | Deeley ................. | C07K 14/535 435/69.1 |
| 6,660,259 B2 | 12/2003 | Laquerre et al. | |
| 7,223,593 B2 * | 5/2007 | Coffin .................... | A61K 48/00 435/320.1 |
| 2002/0072119 A1 * | 6/2002 | Laquerre .............. | C07K 14/005 435/456 |

FOREIGN PATENT DOCUMENTS

| | | |
|---|---|---|
| WO | WO 2001/041801 | 6/2001 |
| WO | WO 2001/045737 | 6/2001 |
| WO | WO 01/53506 | 7/2001 |
| WO | WO 2003/073918 | 9/2003 |
| WO | WO 2011/119925 | 9/2011 |
| WO | WO 2015/059490 | 4/2015 |

OTHER PUBLICATIONS

Clynes D, Jelinska C, Xella B, Ayyub H, Scott C, Mitson M, Taylor S, Higgs DR, Gibbons RJ. Suppression of the alternative lengthening of telomere pathway by the chromatin remodelling factor ATRX. Nat Commun. Jul. 6, 2015;6:7538.*
Reddel RR. Telomere maintenance mechanisms in cancer: clinical implications. Curr Pharm Des. 2014;20(41):6361-74.*
Davison AJ. TAP transporter inhibitor ICP47 [Human herpesvirus 1]. GenBank: AEQ77104.1, Dep. Oct. 24, 2011.*
Everett RD, Boutell C, Orr A. Phenotype of a herpes simplex virus type 1 mutant that fails to express immediate-early regulatory protein ICP0. J Virol. Feb. 2004;78(4):1763-74.*
Han M, Napier CE, Frölich S, Teber E, Wong T, Noble JR, Choi EHY, Everett RD, Cesare AJ, Reddel RR. Synthetic lethality of cytolytic HSV-1 in cancer cells with ATRX and PML deficiency. J Cell Sci. Mar. 14, 2019;132(5).*

(Continued)

*Primary Examiner* — Rachel B Gill
(74) *Attorney, Agent, or Firm* — Klarquist Sparkman, LLP

(57) ABSTRACT

Recombinant herpes simplex virus (HSV)-1 capable of selectively replicating in alternative lengthening of telomeres (ALT)-dependent tumor cells are described. The recombinant HSV-1 are ICP0-deficient, such as by complete deletion of the ICP0 gene, or mutation of the ICP0 gene sufficient to diminish or eliminate E3 ubiquitin ligase activity of ICP0. In some cases, the recombinant HSV-1 further include additional gene deletions or mutations, such as those that render the virus glycoprotein C (gC) deficient, or include a heterologous gene, such as a gene encoding an immunostimulatory molecule. Methods of treating ALT-dependent cancer, and methods of selectively killing ALT-dependent tumor cells are also described.

15 Claims, 24 Drawing Sheets
Specification includes a Sequence Listing.

(56) References Cited

OTHER PUBLICATIONS

Gilbert-Girard, Sheila. Full English Machine Translation. http://hdl.handle.net/20.500.11794/27414. Étude de l'intégration chromosomique de l'herpèsvirus humain de type 6 et impact de son infection sur la reconnaissance des dommages aux télomères. 2016.*

Arora et al., "RNaseH1 Regulates TERRA-telomeric DNA Hybrids and Telomere Maintenance in ALT Tumour Cells," *Nat. Commun.*, vol. 5:5220-5231, 2014.

Cesare et al., "Alternative Lengthening of Telomeres in Mammalian Cells," Madame Curie Bioscience Database—NCBI Bookshelf (ID NBK6486), Landes Bioscience 2000-2013 (16 pages).

Cunha et al., "Widely Used Herpes Simplex Virus 1 ICP0 Deletion Mutant Strain dl1403 and its Derivative Viruses Do Not Express Glycoprotein C Due to a Secondary Mutation in the gC Gene," *PLoS ONE*, vol. 10:e0131129, 2015. (14 pages).

Dilley et al., "ALTernative Telomere Maintenance and Cancer," *Trends Cancer*, vol. 1:145-156, 2015.

Henson et al., "Assaying and Investigating Alternative Lengthening of Telomeres Activity in Human Cells and Cancers," *FEBS Lett.*, vol. 584:3800-3811, 2010.

Muntoni et al., "The First Molecular Details of ALT in Human Tumor Cells," *Hum. Mol. Genet.*, vol. 14:R191-R196, 2005.

Peters et al., "Designing Herpes Viruses as Oncolytics," *Mol. Ther.—Oncolytics*, vol. 2:15010, 2015. (14 pages).

Sapir et al., "Effects of BRCA2 Deficiency on Telomere Recombination in non-ALT and ALT Cells," *Genome Integr.*, vol. 2:2-7, 2011.

Shen et al., "Herpes Simplex Virus 1 (HSV-1) for Cancer Treatment," *Cancer Gene Ther.*, vol. 13:975-992, 2006.

Yao et al., "An Activity Specified by the Osteosarcoma Line U2OS Can Substitute Functionally for ICP0, a Major Regulatory Protein of Herpes Simplex Virus Type 1," *J. Virol.*, vol. 69:6249-6258, 1995.

Deng et al., "HSV-1 Remodels Host Telomeres to Facilitate Viral Replication," *Cell Reports* 9: 2263-2278, 2014.

Gilbert-Girard, "Étude de l'intégration chromosomique de l'herpèsvirus humain de type 6 et impact sur la reconnaissance des dommages aux télomères," URL:https://corpus.ulaval.ca/jspui/bitstream/20.500.1179/27414/1/33215.pdf, Apr. 24, 2018 (with English abstract on p. iv).

Partial Supplementary European Search Report dated Oct. 31, 2019, in related European Application No. 17790364.8 (19 pages).

* cited by examiner

U2OS cells (ALT)

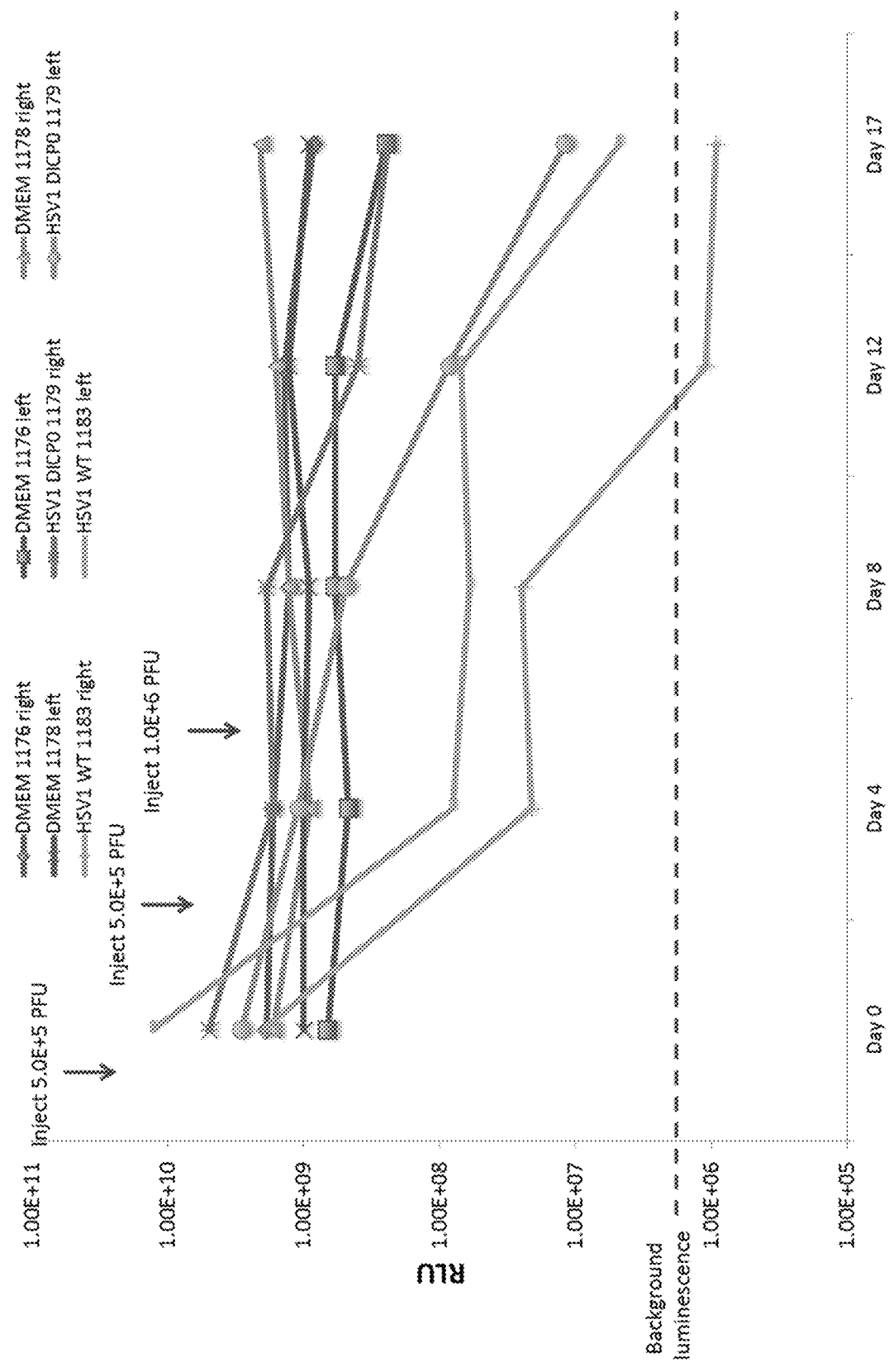

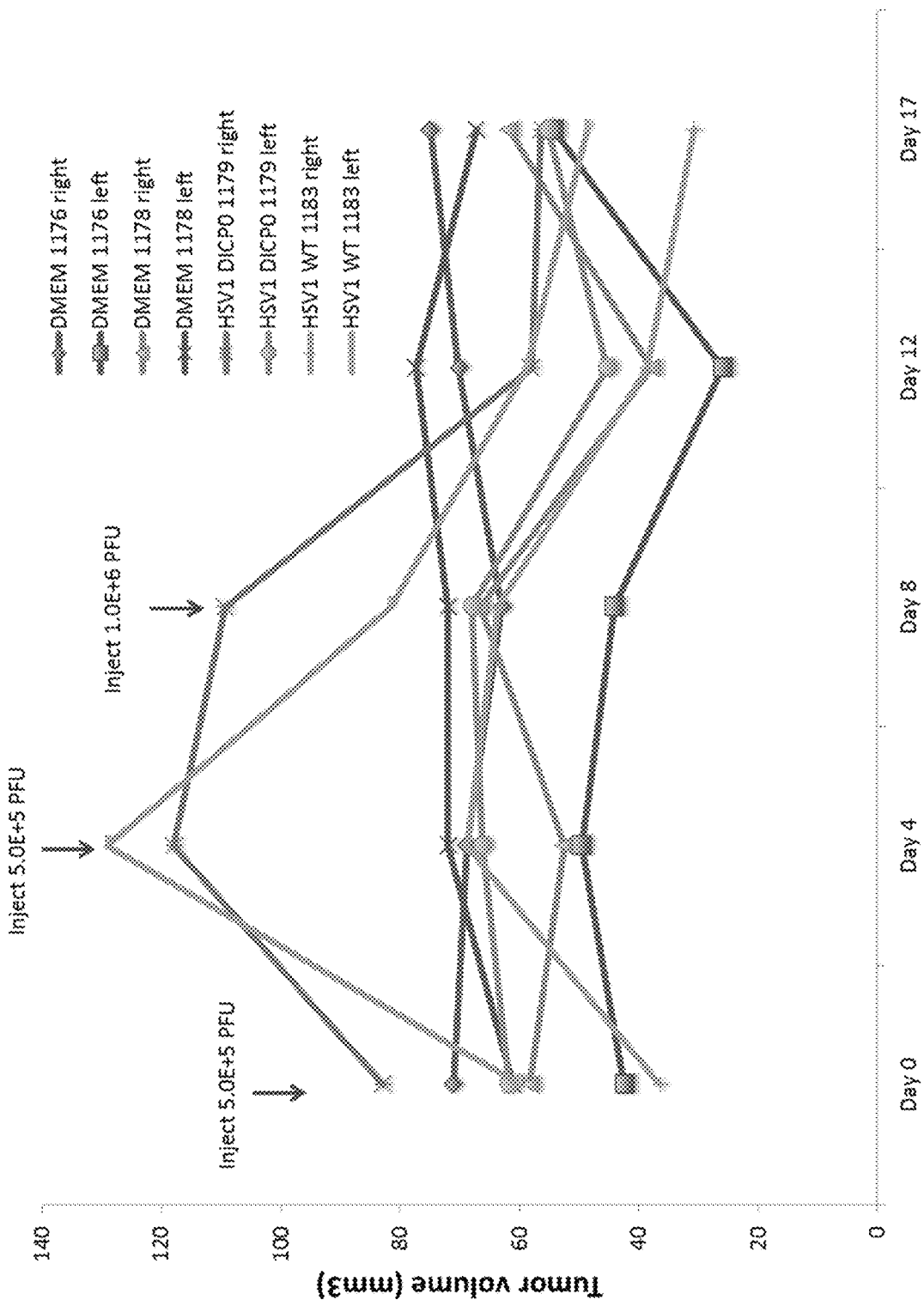

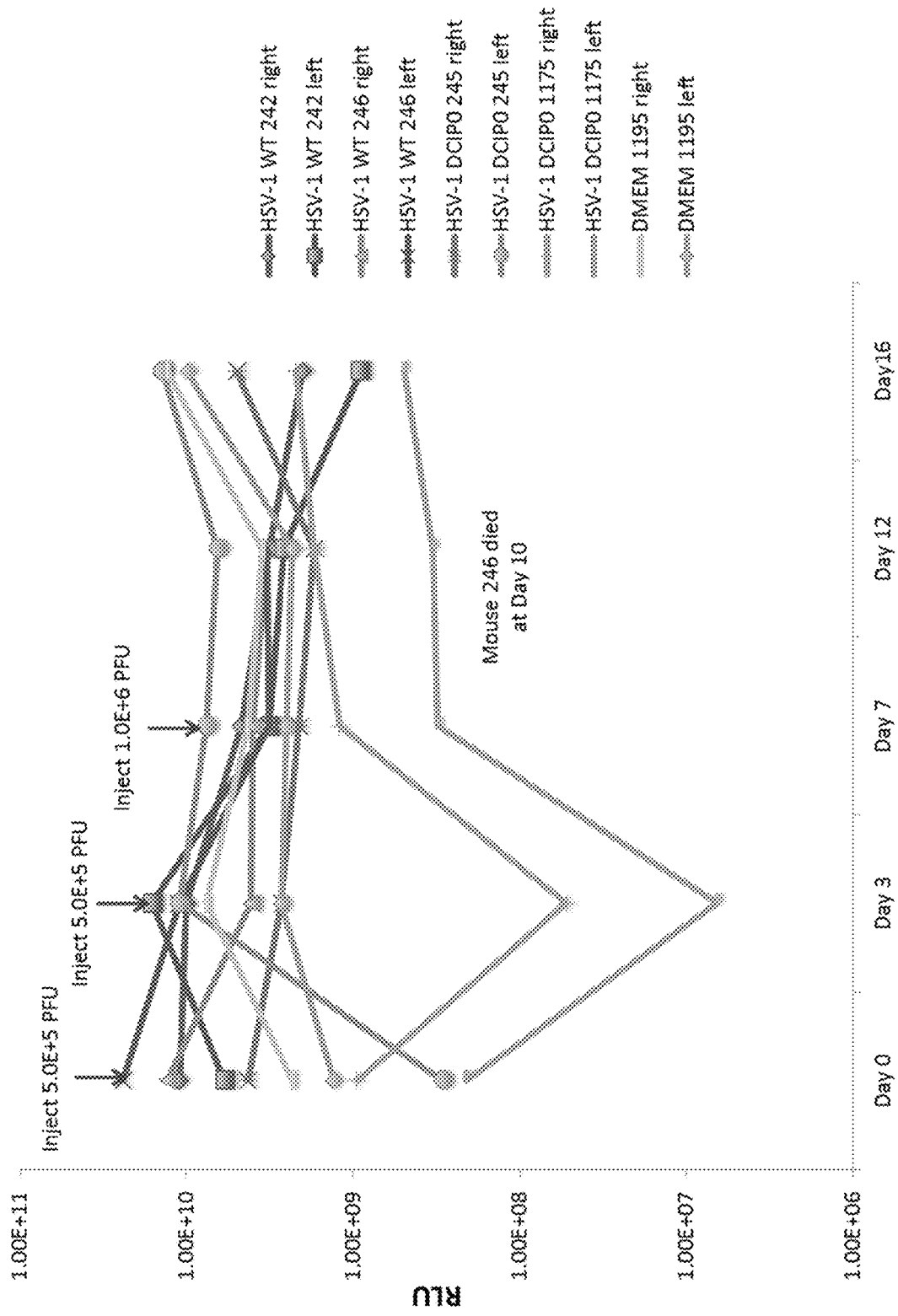

FIG. 10

HSV-1 glycoprotein C nucleotide sequence

```
                       181        SEQ ID NO: 17    200
HSV-1 WT (strain 17)       ...ACCCCCACAT CGACCCCAAA...
HSV-1 ΔiCP0 (strain dl1403) ...ACCCC-ACAT CGACCCCAAA...
                               SEQ ID NO: 18
```

HSV-1 glycoprotein C peptide sequence

```
                       SEQ ID NO: 19           SEQ ID NO: 21
                       60        70            171       180
HSV-1 WT (strain 17)       ...VTPTSTPNPNN............PAPDLEEVLT...
HSV-1 ΔiCP0 (strain dl1403) ...VTPHRPQTPTM............RLPT*
                               SEQ ID NO: 20              SEQ ID NO: 22
```

HSV-1 ONCOLYTIC VIRUS THERAPIES THAT SPECIFICALLY KILL ALT DEPENDENT CANCERS

CROSS REFERENCE TO RELATED APPLICATIONS

This application is a continuation of International Application No. PCT/US2017/029683, filed Apr. 26, 2017, published in English under PCT Article 21(2), which claims the benefit of U.S. Provisional Application No. 62/327,596, filed Apr. 26, 2016. The above-listed applications are herein incorporated by reference in their entirety.

FIELD

This disclosure concerns recombinant herpes simplex viruses that specifically replicate in alternative lengthening of telomeres (ALT)-dependent cancer cells and their use for the treatment of ALT-dependent cancer.

BACKGROUND

Telomeres are specialized DNA repeats at the ends of chromosomes that are replicated by the telomerase enzyme complex. In almost all normal cells with the exception of stem cells, telomerase activity is shut off. As a consequence, telomeres become progressively shorter with every round of cellular DNA replication. When telomeres become critically short, they trigger a cellular DNA damage response that induces irreversible replicative arrest (Shay et al., *Science* 336, 1388-1390, 2012). Thus, telomere shortening is a critical tumor suppressor mechanism that limits the number of times a cell can replicate and divide.

Cancer cells have limitless replicative potential due to their ability to elongate and maintain their telomeres through one of two mutually exclusive mechanisms. In the majority of human cancers, human telomerase reverse transcriptase (hTERT) is upregulated. However, in approximately 10% of human cancers, telomere length is maintained through a homologous recombination-based mechanism known as the alternative lengthening of telomeres (ALT) (Cesare and Reddel, *Nat Rev Genet* 11, 319-330, 2010). The strict dependence of replication on telomere maintenance makes it an attractive target for cancer therapy. However, treatment of mouse tumor models with telomerase inhibitors leads to a switch and outgrowth of ALT-dependent tumors (Hu et al., *Cell* 148, 651-663, 2012). Therefore, if targeting of telomere maintenance is going to be a viable cancer therapeutic option, it is imperative to be able to target telomerase as well as ALT-dependent cancers. Despite nearly two decades since the identification of ALT, there are currently no rational targets or therapies for ALT-dependent tumors.

SUMMARY

Provided herein are methods of treating an alternative lengthening of telomeres (ALT)-dependent cancer in a subject. The methods can include selecting a subject having an ALT-dependent cancer; and administering to the subject a recombinant herpes simplex virus (HSV)-1 that is infected cell protein 0 (ICP0)-deficient, glycoprotein C (gC)-deficient, or both ICP0-deficient and gC-deficient, thereby treating the ALT-dependent cancer in the subject. In some embodiments, the ICP0-deficient HSV-1 has a disruption in the ICP0 gene that diminishes or eliminates expression of functional ICP0. In some examples, the disruption in the ICP0 gene includes a complete deletion of the ICP0 gene, a partial deletion of the ICP0 gene, an insertion in the ICP0 gene and/or a point mutation in the ICP0 gene. In some embodiments, the HSV-1 has a modification of the gC gene that diminishes or eliminates expression of gC, or that results in expression of a truncated gC. In some cases, the recombinant HSV-1 includes disruptions in one or more additional viral genes or includes a heterologous gene, such as a gene encoding an immunostimulatory molecule.

Also provided herein is a recombinant HSV-1 having a complete deletion of the ICP0 gene, and a heterologous gene encoding granulocyte-macrophage colony-stimulating factor (GM-CSF). Further provided is a recombinant HSV-1 having a complete deletion of the ICP0 gene, a partial deletion of the ICP47 gene, and a heterologous gene encoding GM-CSF. Use of the recombinant viruses for the treatment of ALT-dependent cancer is also provided by the present disclosure.

The foregoing and other objects and features of the disclosure will become more apparent from the following detailed description, which proceeds with reference to the accompanying figures.

BRIEF DESCRIPTION OF THE DRAWINGS

(FIG. 1A) Model for the restriction of herpes simplex virus (HSV)-1 replication by promyelocytic leukemia (PML) nuclear bodies (NBs). (FIG. 1B) BJ cells were infected with the indicated virus and incubated for 24 hours post-infection (hpi). Cells were fixed and stained for HSV infected cell polypeptide 4 (ICP4) and PML and the edge of newly forming plaques was imaged on a Zeis LSM 780 confocal microscope at 63× magnification. The viral protein ICP4 marks incoming viral genomes and shows co-localization between PML NBs and viral genomes in the absence of infection cell polypeptide 0 (ICP0). Scale bar is 10 μm. (FIG. 1C) Model for the role of PML NBs in ALT cells. (FIG. 1D) Immunofluorescence-fluorescence in situ hybridization (IF-FISH) of U2OS cells for telomeric C-rich repeats, which are labeled with a peptide nucleic acid (PNA)-TelC FISH probe and anti-PML antibody. Scale bar is 10 μm. (FIG. 1E) 1E5 BJ cells were infected with either HSV-1 wild-type (WT) or HSV-1 ΔICP0 at the indicated multiplicity of infection (MOI) and incubated for 36-48 hours. Plates were stained with crystal violet and plaques were counted. Wells that were completely lysed were considered to have had 100% infection. (FIG. 1F) Plaque assay of U2OS cells infected with HSV-1 WT or HSV-1 ΔICP0 and analyzed as above. (FIG. 1G) U2OS cells were infected with HSV-1 ΔICP0 or left uninfected. At 36-48 hpi, cells were fixed and hybridized with the PNA TelC FISH probe followed by IF staining for PML and ICP4. Cells were imaged at 63× on Zeiss LSM 780 confocal microscope. Scale bar is 10 μm.

(FIG. 2A) Primary small airway epithelial cells (SAEC) were infected with HSV-1 ΔICP0 or HSV-1 WT virus at an MOI=1. At 8 hpi, RNA was collected and subjected to RNA sequencing. Differentially expressed genes between HSV-1 ΔICP0 and HSV-1 WT infected cells are plotted on a volcano plot with those genes that are significantly upregulated in the absence of ICP0 shown to the right of the double vertical lines and those significantly downregulated in the absence of ICP0 shown to the left of the double vertical lines. Significance was determined by a p-value≤0.05 and Log 2 fold change≥0.8 or ≤−0.8. (FIG. 2B) A hypergeometric test was performed using MSigDB to calculate the overlap between the hallmark gene set from MSigDB and those genes significantly upregulated in the absence of ICP0. The top ten overlapping pathways are shown with corresponding p-value. (FIG. 2C) Overlap between the curated gene sets in MSigDB and those genes upregulated in the absence of ICP0. The top ten overlapping pathways are shown with corresponding p-value. (FIG. 2D) The ALT cell line U2OS were infected with HSV-1 ΔICP0 or HSV-1 WT at an MOI=1. At 12 hpi, RNA was collected and subjected to microarray analysis on an affymetrix human Genechip 1.0 ST array. Differentially expressed genes were plotted on a volcano plot with the significantly upregulated genes shown on the upper right and significantly downregulated genes shown on the upper left. Significance was determined by a p-value≤0.05 and Log 2 fold change≥0.8 or ←0.8. (FIG. 2E) Venn diagram showing overlap between the genes significantly suppressed by ICP0 in SAEC and U2OS cells. (FIG. 2F and FIG. 2G) SAOS2 (ALT) and SKBR3 (ALT) cells were infected and RNA from these cells was analyzed by microarray as described for U2OS cells. (FIG. 2H and FIG. 2J) The telomerase positive cell lines HOS and SJSA1 were infected at MOI=1 with HSV-1 ΔICP0 or WT. RNA was collected 12 hpi and analyzed by microarray. Differentially expressed genes are plotted as a volcano plot. Significance was determined by a p-value≤0.05 and Log 2 fold change≥0.58 or ≤−0.58 for HOS and Log 2 fold change≥1 or ≤−1 for SJSA1 cells. (FIG. 2I) Overlap between the hallmark gene set from MSigDB and those genes upregulated in the absence of ICP0. The top ten overlapping pathways are shown with corresponding p-value.

(FIG. 3A) Indicated cells were treated with varying amounts of recombinant interferon (IFN)-α for 4 hours at which point RNA was harvested from the cells. Fold change relative to the untreated control for indicated genes was determined by reverse transcriptase-quantitative polymerase chain reaction (RT-qPCR) using the ΔΔCq method and GAPDH for normalization. Error bars represent the standard error of the mean (SEM). (FIG. 3B) Cells were transfected with an empty plasmid, sheared calf thymus DNA or transfection reagent only and incubated for 6 hours. RNA was collected and fold change relative to untransfected cells was determined by RT-qPCR. (FIG. 3C) HOS or U2OS cells were infected with HSV-1 WT or HSV-1 ΔICP0 at an MOI=1 for 4 hours following which RNA was collected and analyzed by RT-QPCR. (FIG. 4D) HOS or U2OS cells were transfected with 2 µg of PolyI:C or empty plasmid. At 4 hours post-transfection, RNA was harvested and subjected to RT-qPCR using 18s for normalization.

(FIG. 4A) Indicated cells were plated in 24 well plates and infected in duplicate with either HSV-1 WT or HSV-1 ΔICP0 at an experimentally determined MOI that would yield ~30 plaques/well in the HSV-1 WT infected wells. At 36-48 hours post-infection, cells were stained with crystal violet and plaques were counted. The average number of plaques in ΔICP0 infected cells divided by the average number of plaques in WT infected cells was calculated to yield the replication efficiency of HSV-1 ΔICP0 relative to HSV-1 WT in the indicated cell type, which was then normalized to 100%. Error bars represent standard deviation (SD). (FIG. 4B) A model representing the required cellular changes for a cell to transition to ALT. These changes phenocopy HSV-1 ICP0 activity, which subsequently rescues replication of an ICP0-deleted HSV-1.

(FIG. 5A) BJ cells were transfected with the indicated siRNA. At 48 hours post-transfection, cells were harvested for RNA to monitor knock down efficiency of PML, ATRX or DAXX. Fold-change relative to siControl transfected BJ cells was determined by RT-qPCR using the ΔΔCq method and GAPDH as a normalizer. (FIG. 5B) BJ cells were transfected with indicated siRNA. At 48 hours post-transfection, cells were infected with HSV-1 ΔICP0 or HSV-1 WT and a plaque assay was performed.

(FIG. 6A) Full panel of cells screened for sensitivity to IFN-α treatment as described in FIG. 3. Shown from left to right for each dose of IFNα is the transcriptional induction of IFIT1, IFIT2, IFIT3, MX1, OAS1 and OAS2 and MX1. (FIG. 6B) Full panel of cells transfected with empty plasmid DNA of calf thymus DNA as described in FIG. 3. Shown from left to right for each type of DNA is induction of IFIT1, IFIT2, IFIT3, MX1, OAS1 and OAS2 and MX1 mRNA.

FIGS. 7A-7E: Oncolytic HSV-1 administration to nude mice harboring xenograft tumors stably transduced with a lentiviral vector expressing a CMV promoter-driven luciferase reporter gene. (FIG. 7A) Tumor cell viability, as measured by luciferase activity, following administration of HSV-1 WT and HSV-1 ΔICP0 to mice harboring SAOS2 (ALT-dependent) tumor cells. Virus was administered at Day 0 ($5\times10^5$ PFU), Day 3 ($5\times10^5$ PFU) and Day 8 ($1\times10^6$ PFU). (FIG. 7B) Tumor volume following administration of HSV-1 WT and HSV-1 ΔICP0 to mice harboring SAOS2 (ALT-dependent) tumor cells. Virus was administered at Day 0 ($5\times10^5$ PFU), Day 3 ($5\times10^5$ PFU) and Day 8 ($1\times10^6$ PFU). (FIG. 7C) Tumor cell viability following administration of HSV-1 WT and HSV-1 ΔICP0 to mice harboring SAOS2 (ALT-dependent) tumor cells. Virus was administered at Day 0 ($5\times10^5$ PFU), Day 3 ($5\times10^5$ PFU) and Day 5 ($1\times10^6$ PFU). (FIG. 7D) Tumor volume following administration of HSV-1 WT and HSV-1 ΔICP0 to mice harboring SAOS2 (ALT-dependent) tumor cells. Virus was administered at Day 0 ($5\times10^5$ PFU), Day 4 ($5\times10^5$ PFU) and Day 8 ($1\times10^6$ PFU). (FIG. 7E) Tumor cell viability following administration of HSV-1 WT and HSV-1 ΔICP0 to mice harboring A549 (Tel+) tumor cells. Virus was administered at Day 0 ($5\times10^5$ PFU), Day 3 ($5\times10^5$ PFU) and Day 7 ($1\times10^6$ PFU).

FIG. 9A shows ALT cell line SJRH30 in comparison with U2OS. FIG. 9B shows ALT cell line G292 in comparison with U2OS.

FIG. 10 shows the sequence analysis of the HSV-1 gC gene from parental HSV-1 WT (strain 17) and HSV-1 ΔICP0 (strain dl1403). Nucleotide alignment of a fragment of the gC gene between HSV-1 WT (SEQ ID NO: 17) and HSV-1 ΔICP0 (SEQ ID NO: 18) is shown. Deletion is indicated by "-". Numbering of nucleotides is indicated at the top. Also shown is the alignment of gC proteins based on DNA sequence results. The underlined HSV-1 ΔICP0 gC sequence has no homology to the wild type gC protein (WT: SEQ ID NO: 19 from amino acid 60-70, SEQ ID NO: 20 from amino acid 171-180; dl1403: SEQ ID NO: 21 from amino acid 60-70, SEQ ID NO: 22 from amino acid 171-174). Stop codon is indicated by "*". Numbering of amino acids is indicated above the sequences.

SEQUENCE LISTING

Figure 1A:
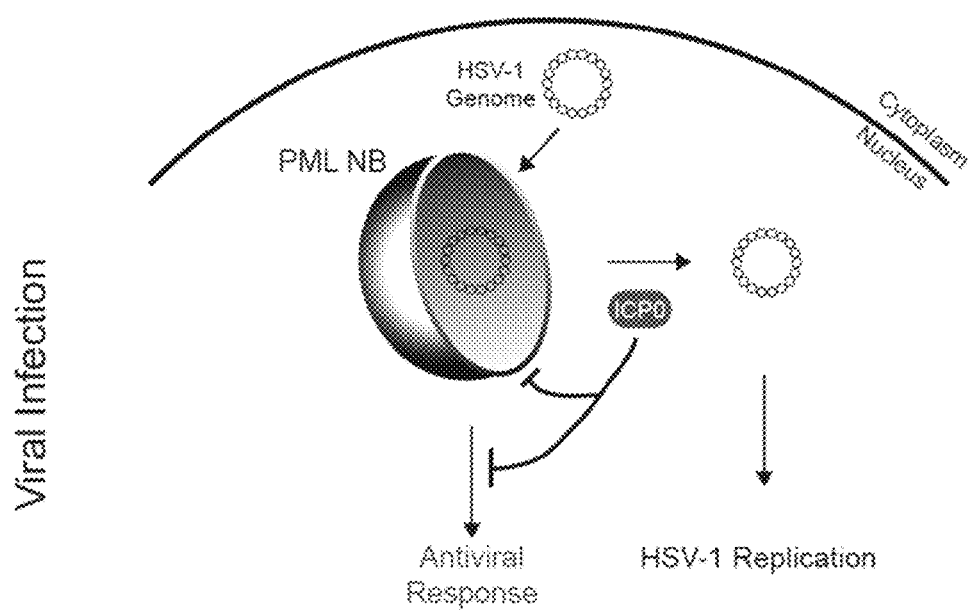
FIGS. 1A-1G.

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file, created on Oct. 15, 2018, 773 KB, which is incorporated by reference herein. In the accompanying sequence listing:

SEQ ID NO: 1 is the nucleotide sequence of the IFIT1 forward primer.

SEQ ID NO: 2 is the nucleotide sequence of the IFIT1 reverse primer.

SEQ ID NO: 3 is the nucleotide sequence of the IFIT2 forward primer.

SEQ ID NO: 4 is the nucleotide sequence of the IFIT2 reverse primer.

SEQ ID NO: 5 is the nucleotide sequence of the IFIT3 forward primer.

SEQ ID NO: 6 is the nucleotide sequence of the IFIT3 reverse primer.

SEQ ID NO: 7 is the nucleotide sequence of the OAS1 forward primer.

SEQ ID NO: 8 is the nucleotide sequence of the OAS1 reverse primer.

SEQ ID NO: 9 is the nucleotide sequence of the OAS2 forward primer.

SEQ ID NO: 10 is the nucleotide sequence of the OAS2 reverse primer.

SEQ ID NO: 11 is the nucleotide sequence of the MX1 forward primer.

SEQ ID NO: 12 is the nucleotide sequence of the MX1 reverse primer.

SEQ ID NO: 13 is the nucleotide sequence of the GAPDH forward primer.

SEQ ID NO: 14 is the nucleotide sequence of the GAPDH reverse primer.

SEQ ID NO: 15 is the nucleotide sequence of HSV-1 ΔICP0 GM-CSF.

SEQ ID NO: 16 is the nucleotide sequence of HSV-1 ΔICP0/ΔICP47 GM-CSF.

SEQ ID NO: 17 is the HSV-1 WT glycoprotein C (gC) nucleotide 181-200 sequence.

SEQ ID NO: 18 is the HSV-1 strain dl1403 gC nucleotide 181-199 sequence.

SEQ ID NO: 19 is the HSV-1 WT gC amino acid 60-70 sequence.

SEQ ID NO: 20 is the HSV-1 strain dl1403 gC amino acid 60-70 sequence.

SEQ ID NO: 21 is the HSV-1 WT gC amino acid 171-180 sequence.

SEQ ID NO: 22 is the HSV-1 strain dl1403 amino acid 171-174 sequence.

SEQ ID NO: 23 is the nucleotide sequence of HSV-1 ΔICP0/ΔgC GM-CSF.

SEQ ID NO: 24 is the nucleotide sequence of HSV-1 ΔICP0/ΔICP47/ΔgC GM-CSF.

SEQ ID NO: 25 is the amino acid sequence of HSV-1 ICP0 corresponding to GenBank Accession No. AEQ77030.1.

SEQ ID NO: 26 is the amino acid sequence of HSV-1 glycoprotein C corresponding to Uniprot P10228.

SEQ ID NO: 27 is the nucleotide sequence of wild-type HSV-1 glycoprotein C corresponding to EMBL-EBI identifier CAA32294.1.

DETAILED DESCRIPTION

I. Abbreviations

ALT alternative lengthening of telomeres
APB ALT-associated PML NB
ECTR extrachromosomal telomeric repeat
hpi hours post-infection
HSV herpes simplex virus
FISH fluorescence in situ hybridization
GBM glioblastoma multiforme
ICP0 Infected cell protein 0
ICP4 infected cell protein 4
IF immunofluorescence
IFN interferon
ISG interferon stimulated gene
MOI multiplicity of infection
NB nuclear body
PML promyelocytic leukemia
PNA peptide nucleic acid
RT-qPCR reverse transcriptase-quantitative polymerase chain reaction
SAEC small airway epithelial cells
SD standard deviation
SEM standard error of the mean
TERT telomerase reverse transcriptase
TMM telomere maintenance mechanism
VECTR viral and extrachromosomal DNA transcriptional response
WT wild-type II. Terms and Methods Unless otherwise noted, technical terms are used according to conventional usage. Definitions of common terms in molecular biology may be found in Benjamin Lewin, *Genes V*, published by Oxford University Press, 1994 (ISBN 0-19-854287-9); Kendrew et al. (eds.), *The Encyclopedia of Molecular Biology*, published by Blackwell Science Ltd., 1994 (ISBN 0-632-02182-9); and Robert A. Meyers (ed.), *Molecular Biology and Biotechnology: a Comprehensive Desk Reference*, published by VCH Publishers, Inc., 1995 (ISBN 1-56081-569-8).

In order to facilitate review of the various embodiments of the disclosure, the following explanations of specific terms are provided:

Administration: To provide or give a subject an agent, such as a therapeutic agent (e.g. an oncolytic virus), by any effective route. Exemplary routes of administration include, but are not limited to, injection (such as subcutaneous, intramuscular, intradermal, intraperitoneal, intratumoral, and intravenous), oral, intraductal, sublingual, rectal, transdermal, intranasal, vaginal and inhalation routes.

Alternative lengthening of telomeres (ALT): A mechanism used by mammalian cells for maintaining telomeres. Approximately 10% of tumors use ALT as a telomere maintenance mechanism (TMM), while the majority of cancers are dependent on telomerase to maintain telomere length.

ALT-dependent cancer: Any type of cancer that relies on ALT for maintaining telomeres. In some embodiments, the ALT-dependent cancer is characterized as being telomerase-negative, having extrachromosomal telomeric repeat (ECTR) DNA, having altered PML bodies, permissive for infection by ICP0-deficient HSV-1 and/or having a VECTR-deficient response. In some embodiments herein, the ALT-dependent cancer is a soft tissue sarcoma, such as but not limited to, a pleomorphic sarcoma, a fibrosarcoma, a leiomyosarcoma, a liposarcoma, an angiosarcoma, an epithelioid sarcoma or a chondrosarcoma. In other embodiments, the ALT-dependent cancer is a cancer of the central nervous system, such as but not limited to an astrocytoma (for example, a diffuse astrocytoma or an anaplastic astrocytoma), glioblastoma multiforme (GBM), an oligodendroglioma, or a medulloblastoma (including anaplastic and non-anaplastic medulloblastoma). In other embodiments, the ALT-dependent cancer is an osteosarcoma.

Chemotherapeutic agent: Any chemical agent with therapeutic usefulness in the treatment of diseases characterized by abnormal cell growth. Such diseases include tumors, neoplasms, and cancer. In one embodiment, a chemotherapeutic agent is a radioactive compound. In one embodiment, a chemotherapeutic agent is a biologic, such as a therapeutic monoclonal antibody. One of skill in the art can readily identify a chemotherapeutic agent of use (see for example, Slapak and Kufe, *Principles of Cancer Therapy*, Chapter 86 in Harrison's Principles of Internal Medicine, 14th edition; Perry et al., *Chemotherapy*, Ch. 17 in Abeloff, Clinical Oncology $2^{nd}$ ed., © 2000 Churchill Livingstone, Inc; Baltzer, L., Berkery, R. (eds.): *Oncology Pocket Guide to Chemotherapy,* 2nd ed. St. Louis, Mosby-Year Book, 1995; Fischer, D. S., Knobf, M. F., Durivage, H. J. (eds): *The Cancer Chemotherapy Handbook,* 4th ed. St. Louis, Mosby-Year Book, 1993). Combination chemotherapy is the administration of more than one agent to treat cancer. One example is the administration of an oncolytic virus used in combination with a radioactive or chemical compound.

Deficient: As used herein, "ICP0-deficient" or "deficient in ICP0" refers to a recombinant virus having a disruption in the ICP0 gene (such as one or more nucleotide insertions, deletions, point mutations, or combinations thereof), which results in a substantial decrease in, or the absence of, functional ICP0 protein. Similarly, "gC-deficient" or "deficient in gC" refers to a recombinant virus having a disruption in the gC gene (such as one or more nucleotide insertions, deletions, point mutations, or combinations thereof), which results in a substantial decrease in, or the absence of, functional gC protein. The HSV-1 genome contains two copies of the ICP0 gene and two copies of the gC gene, therefore an ICP0-deficient virus has a disruption of both copies of the ICP0 gene, and a gC-deficient virus has a disruption of both copies of the gC gene. However, it is not necessary for both copies of the ICP0 gene or the gC gene to have the same type of disruption. For example, one copy of the ICP0 (or gC) gene could be deleted (such as completely deleted), while the second copy could contain a point mutation that prevents expression of functional ICP0 (or gC) protein. Similarly, the recombinant viruses disclosed herein may be deficient in other genes, such as ICP34.5, ICP6 or ICP47, caused by a disruption in the gene. As used herein, the term "diminishes or eliminates expression" of functional protein (such as ICP0, gC, ICP34.5, ICP6 or ICP47 protein) does not refer to only a complete loss of expression, but also includes a decrease, in some cases a substantial decrease, in expression of functional protein, such as a decrease of about 50%, about 60%, about 70%, about 80%, about 90%, about 95%, about 98% or about 99%.

Disruption: As used herein, a "disruption" in a gene refers to any insertion, deletion or point mutation, or any combination thereof. In some embodiments, the disruption leads to a partial or complete loss of expression of mRNA and/or functional protein.

Glycoprotein C (gC): An HSV attachment protein that mediates binding of the virus to cell surface heparan sulfate or chondroitin sulfate. gC is further described as Uniprot P10228. Viral entry of HSV involves viral envelope proteins, glycoprotein C, glycoprotein B, which bind to heparan sulfate. Glycoprotein D is also involved as viral entry and binds to other entry receptors. The HSV-1 gC protein is encoded by the UL44 gene.

Herpes simplex virus (HSV)-1: A member of the Alphaherpesvirinae subfamily of the Herpesviridae family. Herpesviruses have a linear, double-stranded DNA genome that circularizes upon infection. The genome is contained within an icosahedral capsid, which is surrounded by a lipid envelope. The genome of HSV-1 is relatively complex and contains two unique regions, called the long unique region ($U_L$) and the short unique region (Us), and includes two pairs of inverted repeat regions, $TR_L/IR_L$ and $IR_S/TR_S$ (see FIG. 8).

Heterologous: Originating from a separate genetic source or species.

Immunostimulatory molecule: Proteins that function to enhance an immune response. Examples of immunostimulatory molecules include, but are not limited to, granulocyte-macrophage colony-stimulating factor (GM-CSF), C—C motif chemokine ligand 5 (CCL5), C—C motif chemokine ligand 1 (CCL1), interleukin (IL)-12 and B7.1.

Infected cell protein 0 (ICP0): An HSV-1 immediate early (IE) phosphoprotein that functions as a transactivator of viral and cellular genes. ICP0 is important for the progression to lytic infection and for reactivation from latency. This protein includes a RING finger domain with E3 ubiquitin ligase activity. ICP0 is also a minor structural component of the tegument layer of HSV-1 particles. The ICP0 gene is present in two copies within the HSV-1 genome, one copy in each of the $TR_L$ and $IR_L$ inverted repeat regions. ICP0 is further described as UniProt P08393. The amino acid sequence of ICP0 is found in GenBank Accession No. AEQ77030.1.

Infected cell protein 6 (ICP6): A protein encoded by HSV-1 that functions as a ribonucleoside-diphosphate reductase holoenzyme. ICP6, which is also known as ribonucleoside-diphosphate reductase large subunit, is encoded by the UL39 gene. In the context of the present disclosure, the term "ICP6 gene" is used to refer to the gene encoding the ICP6 protein. ICP6 is further described as UniProt P08543.

Infected cell protein 34.5 (ICP34.5): A protein encoded by HSV-1 that contributes to HSV resistance to the antiviral effects of α/β interferon. ICP34.5 also down-regulates host MHC class II proteins and acts as a neurovirulence factor. ICP34.5 is encoded by the RL1 gene. In the context of the present disclosure, the term "ICP34.5 gene" is used to refer to the gene encoding the ICP34.5 protein. ICP34.5 is further described as UniProt P36313.

Infected cell protein 47 (ICP47): A protein encoded by HSV-1 that inhibits the MHC class I pathway in host cells by preventing binding of antigen to TAP. ICP47 is encoded by the US12 gene. In the context of the present disclosure, the term "ICP47 gene" is used to refer to the gene encoding the ICP47 protein. ICP47 is further described as UniProt P03170.

Isolated: An "isolated" biological component, such as a nucleic acid, protein (including antibodies) or organelle, has been substantially separated or purified away from other biological components in the environment (such as a cell) in which the component naturally occurs, i.e., other chromosomal and extra-chromosomal DNA and RNA, proteins and organelles. Nucleic acids and proteins that have been "isolated" include nucleic acids and proteins purified by standard purification methods. The term also embraces nucleic acids and proteins prepared by recombinant expression in a host cell as well as chemically synthesized nucleic acids.

Modification: A change in the sequence of a nucleic acid or protein sequence. For example, amino acid sequence modifications include, for example, substitutions, insertions and deletions, or combinations thereof. Insertions include amino and/or carboxyl terminal fusions as well as intrasequence insertions of single or multiple amino acid residues. Deletions are characterized by the removal of one or more amino acid residues from the protein sequence. In some embodiments herein, the modification (such as a substitution, insertion or deletion) results in a change in function, such as a reduction or enhancement of a particular activity of a protein. As used herein, "Δ" or "delta" refer to a deletion. Substitutional modifications are those in which at least one residue has been removed and a different residue inserted in its place. Amino acid substitutions are typically of single residues, but can occur at a number of different locations at once. Substitutions, deletions, insertions or any combination thereof may be combined to arrive at a final mutant sequence. These modifications can be prepared by modification of nucleotides in the DNA encoding the protein, thereby producing DNA encoding the modification. Techniques for making insertion, deletion and substitution mutations at predetermined sites in DNA having a known sequence are well known in the art. A "modified" protein, nucleic acid or virus is one that has one or more modifications as outlined above.

Neoplasia, malignancy, cancer or tumor: A neoplasm is an abnormal growth of tissue or cells that results from excessive cell division. Neoplastic growth can produce a tumor. The amount of a tumor in an individual is the "tumor burden" which can be measured as the number, volume, or weight of the tumor. A tumor that does not metastasize is referred to as "benign." A tumor that invades the surrounding tissue and/or can metastasize is referred to as "malignant."

Oncolytic virus: A virus that selectively kills cells of a proliferative disorder, e.g., cancer/tumor cells. Killing of the cancer cells can be detected by any method established in the art, such as determining viable cell count, or detecting cytopathic effect, apoptosis, or synthesis of viral proteins in the cancer cells (e.g., by metabolic labeling, immunoblot, or RT-PCR of viral genes necessary for replication), or reduction in size of a tumor.

Operably linked: A first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA sequences are contiguous and, where necessary to join two protein-coding regions, in the same reading frame.

Pharmaceutical agent: A chemical compound or composition capable of inducing a desired therapeutic or prophylactic effect when properly administered to a subject or a cell.

Pharmaceutically acceptable carriers: The pharmaceutically acceptable carriers of use are conventional. *Remington's Pharmaceutical Sciences*, by E. W. Martin, Mack Publishing Co., Easton, Pa., 15th Edition, 1975, describes compositions and formulations suitable for pharmaceutical delivery of the therapeutic recombinant viruses disclosed herein.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (such as powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Preventing, treating or ameliorating a disease: "Preventing" a disease refers to inhibiting the full development of a disease. "Treating" refers to a therapeutic intervention that ameliorates a sign or symptom of a disease or pathological condition after it has begun to develop, such as a reduction in tumor burden (such as the volume or size of a tumor) or a decrease in the number of size of metastases. "Ameliorating" refers to the reduction in the number or severity of signs or symptoms of a disease, such as cancer.

Purified: The term purified does not require absolute purity; rather, it is intended as a relative term. Thus, for example, a purified peptide preparation is one in which the peptide or protein is more enriched than the peptide or protein is in its natural environment within a cell. In one embodiment, a preparation is purified such that the protein or peptide represents at least 50% of the total peptide or protein content of the preparation. Substantial purification denotes purification from other proteins or cellular components. A substantially purified protein is at least 60%, 70%, 80%, 90%, 95% or 98% pure. Thus, in one specific, non-limiting example, a substantially purified protein is 90% free of other proteins or cellular components.

Recombinant: A recombinant nucleic acid molecule, protein or virus is one that has a sequence that is not naturally occurring or has a sequence that is made by an artificial combination of two otherwise separated segments of sequence. This artificial combination can be accomplished by chemical synthesis or by the artificial manipulation of isolated segments of nucleic acid molecules, such as by genetic engineering techniques. The term "recombinant" also includes nucleic acids, proteins and viruses that have been altered solely by addition, substitution, or deletion of a portion of the natural nucleic acid molecule, protein or virus.

Sequence identity: The similarity between amino acid or nucleic acid sequences is expressed in terms of the similarity between the sequences, otherwise referred to as sequence identity. Sequence identity is frequently measured in terms of percentage identity (or similarity or homology); the higher the percentage, the more similar the two sequences are. Homologs or variants of a polypeptide or nucleic acid molecule will possess a relatively high degree of sequence identity when aligned using standard methods.

Methods of alignment of sequences for comparison are well known in the art. Various programs and alignment algorithms are described in: Smith and Waterman, *Adv. Appl.*

Math. 2:482, 1981; Needleman and Wunsch, *J. Mol. Biol.* 48:443, 1970; Pearson and Lipman, *Proc. Natl. Acad. Sci. U.S.A.* 85:2444, 1988; Higgins and Sharp, *Gene* 73:237, 1988; Higgins and Sharp, *CABIOS* 5:151, 1989; Corpet et al., *Nucleic Acids Research* 16:10881, 1988; and Pearson and Lipman, *Proc. Natl. Acad. Sci. U.S.A.* 85:2444, 1988. Altschul et al., *Nature Genet.* 6:119, 1994, presents a detailed consideration of sequence alignment methods and homology calculations.

The NCBI Basic Local Alignment Search Tool (BLAST) (Altschul et al., *J. Mol. Biol.* 215:403, 1990) is available from several sources, including the National Center for Biotechnology Information (NCBI, Bethesda, Md.) and on the internet, for use in connection with the sequence analysis programs blastp, blastn, blastx, tblastn and tblastx. A description of how to determine sequence identity using this program is available on the NCBI website on the internet.

Homologs and variants of an antibody that specifically binds a target antigen or a fragment thereof are typically characterized by possession of at least about 75%, for example at least about 80%, 90%, 95%, 96%, 97%, 98% or 99% sequence identity counted over the full length alignment with the amino acid sequence of the antibody using the NCBI Blast 2.0, gapped blastp set to default parameters. For comparisons of amino acid sequences of greater than about 30 amino acids, the Blast 2 sequences function is employed using the default BLOSUM62 matrix set to default parameters, (gap existence cost of 11, and a per residue gap cost of 1). When aligning short peptides (fewer than around 30 amino acids), the alignment should be performed using the Blast 2 sequences function, employing the PAM30 matrix set to default parameters (open gap 9, extension gap 1 penalties). Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

Subject: Living multi-cellular vertebrate organisms, a category that includes both human and veterinary subjects, including human and non-human mammals.

Synthetic: Produced by artificial means in a laboratory, for example a synthetic nucleic acid or protein can be chemically synthesized in a laboratory.

Therapeutically effective amount: A quantity of a specific substance sufficient to achieve a desired effect in a subject being treated. For instance, this can be the amount necessary to inhibit or suppress growth or metastasis of a tumor. In one embodiment, a therapeutically effective amount is the amount necessary to eliminate, reduce the size, or prevent metastasis of a tumor. When administered to a subject, a dosage will generally be used that will achieve target tissue concentrations (for example, in tumors) that has been shown to achieve a desired in vitro effect.

Unless otherwise explained, all technical and scientific terms used herein have the same meaning as commonly understood by one of ordinary skill in the art to which this disclosure belongs. The singular terms "a," "an," and "the" include plural referents unless context clearly indicates otherwise. "Comprising A or B" means including A, or B, or A and B. It is further to be understood that all base sizes or amino acid sizes, and all molecular weight or molecular mass values, given for nucleic acids or polypeptides are approximate, and are provided for description. Although methods and materials similar or equivalent to those described herein can be used in the practice or testing of the present disclosure, suitable methods and materials are described below. All publications, patent applications, patents, and other references mentioned herein are incorporated by reference in their entirety. In case of conflict, the present specification, including explanations of terms, will control. In addition, the materials, methods, and examples are illustrative only and not intended to be limiting.

III. Introduction

Cellular immortality is a hallmark of cancer that distinguishes tumor cells from normal cells. When a normal somatic cell divides, telomeric DNA at the ends of its chromosomes becomes shorter. If telomeres shorten too much, an alarm signal is generated, and the cell permanently stops dividing and enters senescence or undergoes apoptosis. Telomere shortening therefore acts as a biological mechanism for limiting cellular life span. Cancer cells, on the other hand, can become immortalized by activating a telomere maintenance mechanism (TMM) that counteracts telomere shortening by synthesizing new telomeric DNA from either an RNA template using the enzyme telomerase or a DNA template using a mechanism called alternative lengthening of telomeres (ALT). Because the presence of a TMM is a nearly universal characteristic of cancer cells, and repressing these mechanisms results in cancer cell senescence or death, TMMs have become targets for treating cancer. However, there are currently no ALT-targeted cancer therapies.

It is disclosed herein that the generation of extrachromosomal telomeric repeat (ECTR) DNA in ALT resembles HSV-1 viral genomes and triggers a similar protective response that prevents both viral and tumor replication. This novel anti-viral/anti-tumor DNA immune response signature is referred to herein as the "Viral and Extrachromosomal DNA Transcriptional Response (VECTR)." VECTR triggers immune effectors that protect the host from extrachromosomal viral and cellular DNA. It is further disclosed herein that the VECTR response is inactivated specifically in ALT-dependent, but not telomerase-dependent cancers. This finding led to the prediction that ICP0-null, and/or glycoprotein C (gC) deficient HSV-1 viruses would replicate specifically in cancer cells, but leave normal cells unharmed. To test this, wild-type, gC deficient and ICP0-null HSV-1 virus replication and killing were compared in a panel of telomerase-positive tumors, ALT tumors and normal cells. The results demonstrated that HSV-1 ICP0-null, gC deficient viruses replicate specifically in ALT-dependent cancers. The studies disclosed herein indicate that HSV-1 ICP0-null and/or gC deficient viruses can be used as a selective therapy for treating ALT-dependent cancers.

IV. Overview of Several Embodiments

Provided herein are methods of treating an ALT-dependent cancer in a subject. The method includes administering to the subject a recombinant, ICP0-deficient HSV-1. In some embodiments, the method further includes selecting a subject having an ALT-dependent cancer. In some embodiments, the ICP0-deficient HSV-1 has a disruption in the ICP0 gene that diminishes or eliminates expression of functional ICP0. In some examples, the disruption in the ICP0 gene includes a complete deletion of the ICP0 gene, a partial deletion of the ICP0 gene, an insertion in the ICP0 gene, a point mutation in the ICP0 gene, or any combination thereof. The HSV-1 genome includes two copies of the ICP0 gene, a first copy in $TR_L$ and a second copy in $IR_L$. In the context of the present disclosure, an ICP0-deficient virus has a disruption of both copies of the ICP0 gene. However, it is not necessary for both copies of the ICP0 gene to have the same type of disruption. As one non-limiting example, one copy of the ICP0 gene can be completely deleted, while the second copy can contain a point mutation, partial deletion or insertion that prevents expression of functional ICP0 protein.

In some embodiments, the recombinant ICP0-deficient HSV-1 includes a complete deletion of the ICP0 gene. In particular examples, the recombinant HSV-1 includes a complete deletion of both copies of the ICP0 gene.

In some embodiments, the recombinant ICP0-deficient HSV-1 includes a partial deletion in the ICP0 gene. In particular examples, the partial deletion in the ICP0 gene is in the RING finger domain coding region.

In some embodiments, the recombinant ICP0-deficient HSV-1 includes an insertion or a point mutation in the ICP0 gene. In particular examples, the insertion or point mutation in the ICP0 gene is in the RING finger domain coding region.

In some embodiments, the partial deletion, insertion or point mutation in the ICP0 gene diminishes or eliminates E3 ubiquitin ligase activity of ICP0.

Nonsense mutations at codon 212, 428, 525, and 680 of the ICP0 gene of HSV-1 result in a replication-defective virus that is rescued by U2OS cells. Therefore, mutations in the ICP0 gene up to codon 680 that result in a truncated, functionally inactive, ICP0 protein are contemplated herein. In addition, the RING finger domain within ICP0 has been shown to be important for ICP0 function. Therefore, mutations that disrupt the function of the RING finger domain, thereby resulting in functional inactivation of ICP0, are further contemplated. One such ICP0 mutation that has been previously described is the FxE mutant (Everett et al., *J Gen Virol* 70:1185-1202, 1989; Everett et al., *J Virol* 78(4):1763-1774, 2004).

In some embodiments, the recombinant HSV-1 is glycoprotein C (gC) deficient. In a particular example, the recombinant HSV-1 has a gC gene with a deletion of the cytosine at position 186 relative to the gC gene of wild-type HSV-1. In a particular example, the recombinant HSV-1 includes a gC gene with a premature termination at the $175^{th}$ codon of Gc relative to the gC gene of wild-type HSV-1. In a particular example, the recombinant HSV-1 includes the mutations shown in FIG. 10, in association with HSV-1 strain dl1403. These mutations include a deletion of the cytosine at position 186, and a premature termination at codon 175 (as described in Cunha, et al. Widely used Herpes Simplex Virus 1 ICP0 Deletion Mutant Strain dl1403 and its Derivative Viruses Do Not Express Glycoprotein C Due to a Secondary Mutation in the gC gene. PLOS one. Jul. 17, 2015., incorporated by reference herein). In some embodiments, the HSV-1 has a modification of the gC gene that diminishes or eliminates expression of gC, or that results in expression of a truncated gC.

In some embodiments, the recombinant HSV-1 is both ICP0-deficient and gC deficient.

In some embodiments, the recombinant HSV-1 (which can be ICP0-deficient, gC deficient, or both) includes a heterologous gene. In some examples, the heterologous gene encodes an immunostimulatory molecule. In particular examples, the immunostimulatory molecule is granulocyte-macrophage colony-stimulating factor (GM-CSF), C—C motif chemokine ligand 5 (CCL5), C—C motif chemokine ligand 1 (CCL1), interleukin (IL)-12 or B7.1.

In some embodiments, the recombinant ICP0-deficient HSV-1 further includes a disruption in one or more additional HSV-1 genes that diminishes or eliminates expression of functional protein encoded by the gene(s). In some examples, the recombinant virus further includes a disruption in the ICP47 gene. In some examples, recombinant virus further includes a disruption in the ICP6 gene. In some examples, recombinant virus further includes a disruption in the ICP34.5 gene. The disruption in the ICP47, ICP6 and/or ICP34.5 genes can be a complete deletion, a partial deletion, a point mutation, an insertion, or any combination thereof.

In particular non-limiting embodiments, the recombinant ICP0-deficient HSV-1 includes a complete deletion of the ICP0 gene and includes a heterologous gene encoding GM-CSF. In some examples, the recombinant HSV-1 has a genome sequence at least 80%, at least 85%, at least 90%, at least 95%, at least 96%, at least 97%, at least 98%, or at least 99% identical to SEQ ID NO: 15. In specific examples, the genome sequence of the recombinant HSV-1 comprises or consists of SEQ ID NO: 15.

In other particular non-limiting embodiments, the recombinant ICP0-deficient HSV-1 includes a complete deletion of the ICP0 gene, a partial deletion of the ICP47 gene, and includes a heterologous gene encoding GM-CSF. In some examples, the recombinant HSV-1 has a genome sequence at least 80%, at least 85%, at least 90%, at least 95%, at least 96%, at least 97%, at least 98%, or at least 99% identical to SEQ ID NO: 16. In specific examples, the genome sequence of the recombinant HSV-1 comprises or consists of SEQ ID NO: 16.

In particular non-limiting embodiments, the recombinant ICP0-deficient HSV-1 includes a complete deletion of the ICP0 gene, a mutation in the gC gene (such that it is gC deficient), and includes a heterologous gene encoding GM-CSF. In some examples, the recombinant HSV-1 has a genome sequence at least 80%, at least 85%, at least 90%, at least 95%, at least 96%, at least 97%, at least 98%, or at least 99% identical to SEQ ID NO: 15. In specific examples, the genome sequence of the recombinant HSV-1 comprises or consists of SEQ ID NO: 23.

In other particular non-limiting embodiments, the recombinant ICP0-deficient HSV-1 includes a complete deletion of the ICP0 gene, a partial deletion of the ICP47 gene, a mutation of the gC gene (such that it is gC deficient), and includes a heterologous gene encoding GM-CSF. In some examples, the recombinant HSV-1 has a genome sequence at least 80%, at least 85%, at least 90%, at least 95%, at least 96%, at least 97%, at least 98%, or at least 99% identical to SEQ ID NO: 16. In specific examples, the genome sequence of the recombinant HSV-1 comprises or consists of SEQ ID NO: 24.

Also provided is a method of selectively killing an ALT-dependent tumor cell by administering a recombinant HSV disclosed herein (such as one that is ICP0-deficient, gC deficient, or both ICP0-deficient and gC deficient). In some embodiments, the method is an in vitro method that includes contacting an ALT-dependent tumor cell with a recombinant oncolytic HSV-1. In other embodiments, the method is an in vivo method that includes administering an oncolytic HSV-1 disclosed herein to a subject having an ALT-dependent cancer. In some examples, the in vivo method further includes the step of selecting a subject having an ALT-dependent cancer.

In some embodiments of the methods disclosed herein, the method further includes administering an anti-cancer therapy to the subject. An appropriate anti-cancer therapy can be selected by a medical practitioner. In some examples, the anti-cancer therapy comprises administration of a telomerase inhibitor, chemotherapy, or radiation therapy. In other examples, the anti-cancer therapy includes surgery, such as surgical resection of the tumor.

In specific examples, the recombinant HSV-1 (such as one that is ICP0-deficient, gC deficient, or both ICP0-deficient and gC deficient) is used in combination with a telomerase inhibitor. Telomerase inhibitors have the potential to treat cancers that use telomerase to maintain telomeres. Resistance occurs through the down-regulation of telomerase and the switch to ALT to maintain telomere length. Treating tumors with a telomerase inhibitor and an ICP0 deleted HSV-1 inhibits both means by which a cancer cell can maintain telomere length. Telomerase inhibitors include, for example, inhibitors that target the telomerase reverse transcriptase (TERT) catalytic subunit) or inhibitors that target telomerase RNA. TERT inhibitors include, but are not limited to, antisense oligonucleotides, small interfering RNA (siRNA) and double-stranded RNA (dsRNA) that reduce TERT mRNA, and small molecules such as 3'-azido-2',3'-dideoxythymine (AZT) and BIBR1532. Examples of telomerase RNA inhibitors include antisense oligonucleotides, hammerhead ribozymes and siRNA (Andrews and Tollefsbol, *Methods Mol Biol* 405:1-8, 2008).

In some embodiments, the ALT-dependent cancer is a cancer that is resistant to telomerase inhibitors and/or TERT inhibitors.

In some embodiments herein, the ALT-dependent cancer is a soft tissue sarcoma, such as but not limited to, a pleomorphic sarcoma, a fibrosarcoma, a leiomyosarcoma, a liposarcoma, an angiosarcoma, an epithelioid sarcoma or a chondrosarcoma. In other embodiments, the ALT-dependent cancer is a cancer of the central nervous system, such as but not limited to an astrocytoma (for example, a diffuse astrocytoma or an anaplastic astrocytoma), GBM, an oligodendroglioma, or a medulloblastoma (including anaplastic and non-anaplastic medulloblastoma). In other embodiments, the ALT-dependent cancer is an osteosarcoma.

In order to identify an ALT-dependent cancer, and thereby select a subject having an ALT-dependent cancer who would be responsive to HSV oncolytic therapy, a biopsy taken from the subject's tumor can be screened for one or more hallmarks or indicators of ALT. ALT generates extrachromasomal telomeric repeat (ECTR) DNA that associates and co-localizes with PML nuclear bodies to form ALT-associated PML bodies (APBs). Fluorescence in situ hybridization for telomeric rich DNA together with immunofluorescence for PML NBs for the detection of APBs can be used as a marker for ALT. ECTR DNA can be linear double-stranded, circular double-stranded or circular partially double-stranded (C-Circle). Detection of C-circles via a C-circle assay can also be used to determine whether a tumor cell uses ALT to maintain chromosomes. The level of C-circle DNA in cancer cells has been shown to accurately reflect the level of ALT activity, and this biomarker can be found in the blood of patients who have ALT-dependent cancers (Henson et al., *Nat Biotechnol* 27:1181-1185, 2009). In addition, mutations in ATRx and H3.3 have been reported to associate with ALT and could also be used as an indicator of an ALT-dependent cancer. These assays can be used individually or in combination with the measurement of telomerase levels or telomerase activity to increase the accuracy of identifying ALT cancers. In addition, it is demonstrated herein that the introduction of extrachromosomal DNA, such as a plasmid or sheared calf thymus DNA, into a telomerase-positive cell induces the expression of IFIT1, IFIT2, IFIT3, OAS1 and OAS2, while an ALT cell fails to elicit a similar response. This differential response can also be used in order to identify ALT-dependent cancers.

Further provided herein are recombinant ICP0-deficient HSV-1 that include a heterologous gene. In some embodiments, the heterologous gene is an immunostimulatory molecule. In particular examples, the immunostimulatory molecule is GM-CSF, CCL5, CCL1, IL-12 or B7.1

In particular examples, the recombinant HSV-1 includes a complete deletion of the ICP0 gene and a heterologous gene encoding GM-CSF. In specific examples, the recombinant HSV-1 has a genome sequence at least 80%, at least 85%, at least 90%, at least 95%, at least 96%, at least 97%, at least 98%, or at least 99% identical to SEQ ID NO: 15. In one non-limiting example, the genome sequence of the recombinant HSV-1 comprises or consists of SEQ ID NO: 15.

Also provided herein are recombinant ICP0-deficient HSV-1 that include disruptions in one or more additional HSV-1 genes. In some embodiments, the one or more genes are selected from ICP34.5, ICP6 and ICP47. In some examples, the disruption is a complete deletion, a partial deletion, a point mutation or an insertion. In some instances, the recombinant HSV-1 further includes a heterologous gene, such as, but not limited to, a gene encoding an immunostimulatory molecule.

In particular examples, the recombinant HSV-1 includes a complete deletion of the ICP0 gene, a partial deletion of the ICP47 gene and a heterologous gene encoding GM-CSF. In specific examples, the recombinant HSV-1 has a genome sequence at least 80%, at least 85%, at least 90%, at least 95%, at least 96%, at least 97%, at least 98%, or at least 99% identical to SEQ ID NO: 16. In one non-limiting example, the genome sequence of the recombinant HSV-1 comprises or consists of SEQ ID NO: 16.

Use of the recombinant HSV-1 disclosed herein methods of treating an ALT-dependent cancer in a subject is also provided herein. The method includes administering a recombinant HSV-1 disclosed herein to the subject. In some embodiments, the method further includes selecting a subject having an ALT-dependent cancer.

V. Pharmaceutical Compositions of Oncolytic HSV

Provided herein are compositions comprising a recombinant HSV, such as one that is ICP0-deficient, gC deficient, or both ICP0-deficient and gC deficient. The compositions are, optionally, suitable for formulation and administration in vitro or in vivo. Optionally, the compositions comprise one or more of the provided agents and a pharmaceutically acceptable carrier. Suitable carriers and their formulations are described in *Remington: The Science and Practice of Pharmacy*, $22^{nd}$ *Edition*, Loyd V. Allen et al., editors, Pharmaceutical Press (2012). Pharmaceutically acceptable carriers include materials that are not biologically or otherwise undesirable, i.e., the material is administered to a subject without causing undesirable biological effects or interacting in a deleterious manner with the other components of the pharmaceutical composition in which it is contained. If administered to a subject, the carrier is optionally selected to minimize degradation of the active ingredient and to minimize adverse side effects in the subject.

The recombinant viruses are administered in accord with known methods, such as intravenous administration, e.g., as a bolus or by continuous infusion over a period of time, by intramuscular, intraperitoneal, intracerobrospinal, subcutaneous, intra-articular, intrasynovial, intrathecal, oral, topical, intratumoral or inhalation routes. The administration may be local (such as intratumoral) or systemic. The compositions can be administered via any of several routes of administration, including topically, orally, parenterally, intravenously, intra-articularly, intraperitoneally, intramuscularly, subcutaneously, intracavity, transdermally, intrahepatically, intracranially, nebulization/inhalation, or by installation via bronchoscopy. Thus, the compositions are administered in a number of ways depending on whether local or systemic treatment is desired, and on the area to be treated.

In some embodiments, the compositions for administration will include a recombinant virus as described herein dissolved in a pharmaceutically acceptable carrier, preferably an aqueous carrier. A variety of aqueous carriers can be used, e.g., buffered saline and the like. These solutions are sterile and generally free of undesirable matter. These compositions may be sterilized by conventional, well known sterilization techniques. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like. The concentration of active agent in these formulations can vary widely, and will be selected primarily based on fluid volumes, viscosities, body weight and the like in accordance with the particular mode of administration selected and the subject's needs.

Pharmaceutical formulations, particularly, of the recombinant viruses can be prepared by mixing the recombinant virus having the desired degree of purity with optional pharmaceutically acceptable carriers, excipients or stabilizers. Such formulations can be lyophilized formulations or aqueous solutions.

Acceptable carriers, excipients, or stabilizers are nontoxic to recipients at the dosages and concentrations used. Acceptable carriers, excipients or stabilizers can be acetate, phosphate, citrate, and other organic acids; antioxidants (e.g., ascorbic acid) preservatives, low molecular weight polypeptides; proteins, such as serum albumin or gelatin, or hydrophilic polymers such as polyvinylpyllolidone; and amino acids, monosaccharides, disaccharides, and other carbohydrates including glucose, mannose, or dextrins; chelating agents; and ionic and non-ionic surfactants (e.g., polysorbate); salt-forming counter-ions such as sodium; metal complexes (e.g. Zn-protein complexes); and/or non-ionic surfactants. The recombinant HSV can be formulated at any appropriate concentration of infectious units.

Formulations suitable for oral administration can consist of (a) liquid solutions, such as an effective amount of the recombinant virus suspended in diluents, such as water, saline or PEG 400; (b) capsules, sachets or tablets, each containing a predetermined amount of the active ingredient, as liquids, solids, granules or gelatin; (c) suspensions in an appropriate liquid; and (d) suitable emulsions. Tablet forms can include one or more of lactose, sucrose, mannitol, sorbitol, calcium phosphates, corn starch, potato starch, microcrystalline cellulose, gelatin, colloidal silicon dioxide, talc, magnesium stearate, stearic acid, and other excipients, colorants, fillers, binders, diluents, buffering agents, moistening agents, preservatives, flavoring agents, dyes, disintegrating agents, and pharmaceutically compatible carriers. Lozenge forms can comprise the active ingredient in a flavor, e.g., sucrose, as well as pastilles comprising the active ingredient in an inert base, such as gelatin and glycerin or sucrose and acacia emulsions, gels, and the like containing, in addition to the active ingredient, carriers known in the art.

The recombinant HSV, alone or in combination with other suitable components, can be made into aerosol formulations (i.e., they can be "nebulized") to be administered via inhalation. Aerosol formulations can be placed into pressurized acceptable propellants, such as dichlorodifluoromethane, propane, nitrogen, and the like.

Formulations suitable for parenteral administration, such as, for example, by intraarticular (in the joints), intravenous, intramuscular, intratumoral, intradermal, intraperitoneal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. In the provided methods, compositions can be administered, for example, by intravenous infusion, orally, topically, intraperitoneally, intravesically intratumorally, or intrathecally. In some embodiments, parenteral administration, intratumoral administration, or intravenous administration are the methods of administration. The formulations of compounds can be presented in unit-dose or multi-dose sealed containers, such as ampules and vials.

Injection solutions and suspensions can be prepared from sterile powders, granules, and tablets of the kind previously described. Cells transduced or infected by recombinant HSV or transfected with nucleic acids for ex vivo therapy can also be administered intravenously or parenterally as described above.

In some embodiments, the pharmaceutical preparation is in unit dosage form. In such form the preparation is subdivided into unit doses containing appropriate quantities of the active component. Thus, the pharmaceutical compositions can be administered in a variety of unit dosage forms depending upon the method of administration. For example, unit dosage forms suitable for oral administration include, but are not limited to, powder, tablets, pills, capsules and lozenges.

V. Methods of Treatment Using Oncolytic HSV

The recombinant HSV compositions disclosed herein (such as those that include an HSV that is ICP0-deficient, gC deficient, or both ICP0-deficient and gC deficient) can be administered for therapeutic or prophylactic treatment. In particular, provided are methods of inhibiting ALT-dependent tumor cell viability in a subject, inhibiting ALT-dependent tumor progression in a subject, reducing ALT-dependent tumor volume in a subject and/or treating ALT-dependent cancer in a subject. The methods include administering a therapeutically effective amount of a recombinant HSV (or composition thereof) to the subject. In some embodiments, the method further includes selecting a subject having an ALT-dependent cancer. As described throughout, the oncolytic HSV or pharmaceutical composition is administered in any number of ways including, but not limited to, intravenously, intravascularly, intrathecally, intramuscularly, subcutaneously, intratumorally, intraperitoneally, or orally. Optionally, the method further comprises administering to the subject one or more additional therapeutic agents. In some embodiments, the therapeutic agent is a chemotherapeutic agent (such as cisplatin, 5-FU, carboplatin, and the like). In some embodiments, the therapeutic agent is a biologic agent (such as trastuzumab, cetuximab, ribuximab, panitumumab, and the like, see for example Scott et al., *Nature Reviews Cancer* 12:278-287, 2012, herein incorporated by reference). In other embodiments, the therapeutic agent is a telomerase inhibitor. In other embodiments, the therapeutic agent is an immune modulator.

In some embodiments, the ALT-dependent cancer or tumor is a soft tissue sarcoma, an osteosarcoma, or a cancer of the central nervous system, such as an astrocytoma. In some cases, the cancer is metastatic. In some examples, the tumor is a tumor of the mammary, pituitary, thyroid, or prostate gland; a tumor of the brain, liver, meninges, bone, ovary, uterus, or cervix; monocytic or myelogenous leukemia; adenocarcinoma, adenoma, astrocytoma, bladder tumor, brain tumor, Burkitt's lymphoma, breast carcinoma, cervical carcinoma, colon carcinoma, kidney carcinoma, liver carcinoma, lung carcinoma, ovarian carcinoma, pancreatic carcinoma, prostate carcinoma, rectal carcinoma, skin carcinoma, stomach carcinoma, testis carcinoma, thyroid carcinoma, chondrosarcoma, choriocarcinoma, fibroma, fibrosarcoma, glioblastoma, glioma, hepatoma, histiocytoma, leiomyoblastoma, leiomyosarcoma, lymphoma, liposarcoma cell, mammary tumor, medulloblastoma, myeloma, plasmacytoma, neuroblastoma, neuroglioma, osteogenic sarcoma, pancreatic tumor, pituitary tumor, retinoblastoma, rhabdomyosarcoma, sarcoma, testicular tumor, thymoma, or Wilms tumor. Tumors include both primary and metastatic solid tumors, including carcinomas of breast, colon, rectum, lung, oropharynx, hypopharynx, esophagus, stomach, pancreas, liver, gallbladder and bile ducts, small intestine, urinary tract (including kidney, bladder and urothelium), female genital tract, (including cervix, uterus, and ovaries as well as choriocarcinoma and gestational trophoblastic disease), male genital tract (including prostate, seminal vesicles, testes and germ cell tumors), endocrine glands (including the thyroid, adrenal, and pituitary glands), and skin, as well as hemangiomas, melanomas, sarcomas (including those arising from bone and soft tissues as well as Kaposi's sarcoma) and tumors of the brain, nerves, eyes, and meninges (including astrocytomas, gliomas, glioblastomas, retinoblastomas, neuromas, neuroblastomas, Schwannomas, and meningiomas). In some aspects, solid tumors may be treated that arise from hematopoietic malignancies such as leukemias (i.e. chloromas, plasmacytomas and the plaques and tumors of mycosis fungoides and cutaneous T-cell lymphoma/leukemia) as well as in the treatment of lymphomas (both Hodgkin's and non-Hodgkin's lymphomas). In addition, treatments may be useful in the prevention of metastases from the tumors described herein.

In therapeutic applications, recombinant HSV or compositions thereof are administered to a subject in a therapeutically effective amount or dose. Amounts effective for this use will depend upon the severity of the disease and the general state of the patient's health. Single or multiple administrations of the compositions may be administered depending on the dosage and frequency as required and tolerated by the patient. A "patient" or "subject" includes both humans and other animals, particularly mammals (such as cats, dogs, cows, sheep, and pigs). Thus, the methods are applicable to both human therapy and veterinary applications.

An effective amount of a recombinant HSV is determined on an individual basis and is based, at least in part, on the particular recombinant virus used; the individual's size, age, gender; and the size and other characteristics of the proliferating cells. For example, for treatment of a human, at least $10^3$ plaque forming units (PFU) of a recombinant virus is used, such as at least $10^4$, at least $10^5$, at least $10^6$, at least $10^7$, at least $10^8$, at least $10^9$, at least $10^{10}$, at least $10^{11}$, or at least $10^{12}$ PFU, for example approximately $10^3$ to $10^{12}$ PFU of a recombinant virus is used, depending on the type, size and number of proliferating cells or neoplasms present. The effective amount can be from about 1.0 pfu/kg body weight to about $10^{15}$ pfu/kg body weight (e.g., from about $10^2$ pfu/kg body weight to about $10^{13}$ pfu/kg body weight). A recombinant HSV is administered in a single dose or in multiple doses (e.g., two, three, four, six, or more doses). Multiple doses can be administered concurrently or consecutively (e.g., over a period of days or weeks).

Administration of the HSV-1 oncolytic viruses disclosed herein can also be accompanied by administration of other anti-cancer agents or therapeutic treatments (such as surgical resection of a tumor and/or treatment with a telomerase inhibitor). Any suitable anti-cancer agent can be administered in combination with the recombinant viruses disclosed herein. Exemplary anti-cancer agents include, but are not limited to, chemotherapeutic agents, such as, for example, mitotic inhibitors, alkylating agents, anti-metabolites, intercalating antibiotics, growth factor inhibitors, cell cycle inhibitors, enzymes, topoisomerase inhibitors, anti-survival agents, biological response modifiers, anti-hormones (e.g. anti-androgens), CDK inhibitors and anti-angiogenesis agents. Other anti-cancer treatments include radiation therapy and other antibodies that specifically target cancer cells (e.g., biologics).

Non-limiting examples of alkylating agents include nitrogen mustards (such as mechlorethamine, cyclophosphamide, melphalan, uracil mustard or chlorambucil), alkyl sulfonates (such as busulfan), nitrosoureas (such as carmustine, lomustine, semustine, streptozocin, or dacarbazine).

Non-limiting examples of antimetabolites include folic acid analogs (such as methotrexate), pyrimidine analogs (such as 5-FU or cytarabine), and purine analogs, such as mercaptopurine or thioguanine.

Non-limiting examples of natural products include vinca alkaloids (such as vinblastine, vincristine, or vindesine), epipodophyllotoxins (such as etoposide or teniposide), antibiotics (such as dactinomycin, daunorubicin, doxorubicin, bleomycin, plicamycin, or mitomycin C), and enzymes (such as L-asparaginase).

Non-limiting examples of miscellaneous agents include platinum coordination complexes (such as cis-diamine-dichloroplatinum II also known as cisplatin), substituted ureas (such as hydroxyurea), methyl hydrazine derivatives (such as procarbazine), and adrenocrotical suppressants (such as mitotane and aminoglutethimide).

Non-limiting examples of hormones and antagonists include adrenocorticosteroids (such as prednisone), progestins (such as hydroxyprogesterone caproate, medroxyprogesterone acetate, and magestrol acetate), estrogens (such as diethylstilbestrol and ethinyl estradiol), antiestrogens (such as tamoxifen), and androgens (such as testerone proprionate and fluoxymesterone). Examples of the most commonly used chemotherapy drugs include Adriamycin, Alkeran, Ara-C, BiCNU, Busulfan, CCNU, Carboplatinum, Cisplatinum, Cytoxan, Daunorubicin, DTIC, 5-FU, Fludarabine, Hydrea, Idarubicin, Ifosfamide, Methotrexate, Mithramycin, Mitomycin, Mitoxantrone, Nitrogen Mustard, Taxol (or other taxanes, such as docetaxel), Velban, Vincristine, VP-16, while some more newer drugs include Gemcitabine (Gemzar), Herceptin, Irinotecan (Camptosar, CPT-11), Leustatin, Navelbine, Rituxan STI-571, Taxotere, Topotecan (Hycamtin), Xeloda (Capecitabine), Zevelin and calcitriol.

Non-limiting examples of immunomodulators that can be used include AS-101 (Wyeth-Ayerst Labs.), bropirimine (Upjohn), gamma interferon (Genentech), GM-CSF (granulocyte macrophage colony stimulating factor; Genetics Institute), IL-2 (Cetus or Hoffman-LaRoche), human immune globulin (Cutter Biological), IMREG (from Imreg of New Orleans, La.), SK&F 106528, and TNF (tumor necrosis factor; Genentech).

Another common treatment for some types of cancer is surgical treatment, for example surgical resection of the cancer or a portion of it. Another example of a treatment is radiotherapy, for example administration of radioactive material or energy (such as external beam therapy) to the tumor site to help eradicate the tumor or shrink it prior to surgical resection.

CDK (Cyclin-dependent kinase) inhibitors are agents that inhibit the function of CDKs. Non-limiting examples of CDK inhibitors for use in the provided methods include AG-024322, AT7519, AZD5438, flavopiridol, indisulam, P1446A-05, PD-0332991, and P276-00 (see e.g., Lapenna et al., Nature Reviews, 8:547-566, 2009). Other CDK inhibitors include LY2835219, Palbociclib, LEE011 (Novartis), pan-CDK inhibitor AT7519, seliciclib, CYC065, butyrolactone hymenialdisine, SU9516, CINK4, PD0183812 or fascaplysin.

In some examples, the CDK inhibitor is a broad-range inhibitor (such as flavopiridol, olomoucine, roscovitine, kenpaullone, SNS-032, AT7519, AG-024322, (S)-Roscovitine or R547). In other examples, the CDK inhibitor is a specific inhibitor (such as fascaplysin, ryuvidine, purvalanol A, NU2058, BML-259, SU 9516, PD0332991 or P-276-00).

The choice of agent and dosage can be determined readily by one of skill in the art based on the given disease being treated. Combinations of agents or compositions can be administered either concomitantly (e.g., as a mixture), separately but simultaneously (e.g., via separate intravenous lines) or sequentially (e.g., one agent is administered first followed by administration of the second agent). Thus, the term combination is used to refer to concomitant, simultaneous or sequential administration of two or more agents or compositions.

According to the methods disclosed herein, the subject is administered an effective amount of one or more of the agents provided herein. The effective amount is defined as any amount necessary to produce a desired physiologic response (e.g., killing of an ALT-dependent cancer cell). Therapeutic agents are typically administered at the initial dosage of about 0.001 mg/kg to about 1000 mg/kg daily. A dose range of about 0.01 mg/kg to about 500 mg/kg, or about 0.1 mg/kg to about 200 mg/kg, or about 1 mg/kg to about 100 mg/kg, or about 10 mg/kg to about 50 mg/kg, can be used. The dosages, however, may be varied depending upon the requirements of the subject, the severity of the condition being treated, and the compound being employed. For example, dosages can be empirically determined considering the type and stage of cancer diagnosed in a particular subject. The dose administered to a subject, in the context of the provided methods should be sufficient to affect a beneficial therapeutic response in the patient over time. Determination of the proper dosage for a particular situation is within the skill of the practitioner. Thus, effective amounts and schedules for administering the agent may be determined empirically by one skilled in the art. The dosage should not be so large as to cause substantial adverse side effects, such as unwanted cross-reactions, anaphylactic reactions, and the like. The dosage can be adjusted by the individual physician in the event of any contraindications. Guidance can be found in the literature for appropriate dosages for given classes of pharmaceutical products.

The following examples are provided to illustrate certain particular features and/or embodiments. These examples should not be construed to limit the disclosure to the particular features or embodiments described.

EXAMPLES

Example 1: Materials and Methods

This examples describes the materials and experimental procedures used for the studies described in Example 2.

Cell Lines

HOS, SJSA1, U2OS, SAOS2, KMST6, SUSM-1, SKBR3, SK-LU-1, HeLa LT (O'Sullivan et al., *Nat Struct Mol Biol* 21, 167-174, 2014), HFF, DAOY, A549, H1299, L229N, A172, U87MG, T98G, DBTRG, WI-38 VA13/R2 GM847, SJRH30, and G292 were grown in DMEM with 10% FBS at 37° C. and 5% $CO_2$. BJ cells were grown in MEM, NEAA, sodium pyruvate and 10% FBS at 37° C. and 5% $CO_2$. SAEC were from Lonza and grown in SABM supplemented with SAGM SINGLEQUOTS™ and grown at 37° C. in 5% $CO_2$ and 3% $O_2$. LS2, HIO107, HIO107 hTERT, HIO118 and HIO 118 hTERT cells were provided by Domonique Broccoli (Plantinga et al., *Mol Cancer Res* 11, 557-567, 2013; Mitchell, *Mol Cancer Ther* 9, 682-692, 2010). LS2 cells were grown in RPMI supplemented with 1×GLUTAMAX™ (Life Technologies), 1×MEM essential vitamin mix (Lonza cat #13-607c), 1×ITES (Lonza cat #17-839z), 1× Pen/Strep/L-glut (Life Technologies cat #10378-016), 1 mM sodium pyruvate (MP Biomedical cat #1682049), 1x non-essential amino acids (Lonza cat #13-114E) and 20% FBS at 37° C. and 5% $CO_2$. HIO cells were grown in a 1:1 dilution of Medium 199 (Sigma-Aldrich cat # M4530) and MCDB 105 (Sigma cat # M6395) supplemented with 4% FBS, 1×Glutagro (Cellgro cat #25-015-Cl) and 0.2 U insulin (Santa Cruz Biotechnology cat # sc-360248) at 37° C. and 5% $CO_2$. SW872 were purchased from ATCC and initially cultured in L15 medium supplemented with 10% FBS at 37° C. without $CO_2$. These cells were then conditioned to grow in LS2 medium and all subsequent experiments with these cells were done in LS2 medium.

Viruses, Infections and Plaque Assay

The HSV-1 strains used in the studies disclosed herein were the 17syn+ wild type (WT) and the matched ICP0 deletion mutant (ΔICP0) dl1403 (Stow and Stow, *J Gen Virol* 67 (Pt 12), 2571-2585, 1986). Viruses were grown in Vero cells as follows. A 90% confluent 15 cm plate was infected at an MOI of 0.001 for HSV-1 WT and 0.1 for HSV-1 ΔICP0 and incubated until cells were rounded but still attached to the plate, typically 3-5 days. Both the media and cells were collected and slowly frozen at −80° C. followed by a quick thaw at 37° C. for a total of 3 freeze/thaw cycles. The mixture was spun at 3000 RPM for 15 minutes and the resulting supernatant was collected and spun for an additional 15 minutes at 3000 RPM to remove any residual cell debris. The supernatant from this spin was collected, aliquoted and stored at −80° C.

For tittering, one aliquot was thawed and tittered on U2OS cells by plaque assay since these cells fully rescue replication of ICP0 deleted HSV-1. U2OS cells (100,000) were plated in 24-well plates and allowed to attach for 6 hours. The virus was serial diluted in DMEM without serum yielding a dilution range from $10^{-3}$ to $10^{-8}$. The diluted virus was added to the cells (3 wells/dilution) and incubated for 1 hour at 37° C. The virus was removed and replaced with DMEM containing 10% FBS and 1% human serum and incubated for 36-48 hours until clear plaques were visible. To better visualize the plaques, the media was removed and 1 mg/mL crystal violet dissolved in 20% ethanol was added to each well and incubated for 10 minutes. Each well was washed once with PBS and plaques were counted in the well with the least number of observable plaques. The average number of plaques from 3 wells of the same dilution was calculated. The titer equals the average number of plaques counted×$10^{(dilution\ number)}$ pfu/mL. For all other plaque assays, the cells were infected at the indicated multiplicity of infection (MOI), which was calculated based on viral titer and number of cells per well.

To examine the co-localization of incoming HSV-1 viral genomes with PML NBs, cells were infected with HSV-1 WT or ΔICP0 as described above and incubated for 24 hours. Cells were washed, fixed and stained with antibodies against ICP4 and PML. The edges of plaques were imaged by confocal microscopy at 63× magnification for cells in the early stages of infection.

RT-qPCR Analysis

The Ambion PURELINK™ RNA Mini Kit (cat #12183018A) was used for the isolation of RNA according to the manufacturer's recommendations. Total RNA was DNase treated using the Ambion DNA-free kit (cat # AM1906) and 1 μg of total RNA was reverse transcribed using the Bio-Rad iScript Reverse Transcription Supermix for RT-qPCR (cat #170-8840). The cDNA was diluted to a final volume of 100 μL and 2 μL was used to set up 10 μL RT-qPCR reactions with Kapa SYBR™ Fast qPCR Universal Master Mix (Kapa Biosystems cat # KK4601). All samples were run in duplicate on a Bio-Rad CFX96 real-time system. The reactions were heated to 95° C. for 30 seconds followed by 40 cycles of 95° C. for 5 seconds and 61° C. for 30 seconds. Following the 40 cycles, a melt curve analysis was performed to ensure amplification of a single product. The target genes were detected using the following primers:

```
                                          (SEQ ID NO: 1)
IFIT1 (Fwd) TGTCCAAGGTGGTAAAGGGTG (SEQ ID NO: 2)
IFIT1 (Rev) CAGGTCACCAGACTCCTCAC (SEQ ID NO: 3)
IFIT2 (Fwd) AAGCACCTCAAAGGGCAAAAC (SEQ ID NO: 4)
IFIT2 (Rev) TCGGCCCATGTGATAGTAGAC (SEQ ID NO: 5)
IFIT3 (Fwd) TCAGAAGTCTAGTCACTTGGGG (SEQ ID NO: 6)
IFIT3 (Rev) ACACCTTCGCCCTTTCATTTC (SEQ ID NO: 7)
OAS1 (Fwd) TGTCCAAGGTGGTAAAGGGTG (SEQ ID NO: 8)
OAS1 (Rev) CCGGCGATTTAACTGATCCTG (SEQ ID NO: 9)
OAS2 (Fwd) AGGTGGCTCCTATGGACGG (SEQ ID NO: 10)
OAS2 (Rev) TTTATCGAGGATGTCACGTTGG (SEQ ID NO: 11)
MX1 (Fwd) CAGCACCTGATGGCCTATCA (SEQ ID NO: 12)
MX1 (Rev) ACGTCTGGAGCATGAAGAACTG (SEQ ID NO: 13)
GAPDH (Fwd) TTCGACAGTCAGCCGCATCTTCTT (SEQ ID NO: 14)
GAPDH (Rev) CAGGCGCCCAATACGACCAAATC
```

The ΔΔCq method was used to calculate changes in mRNA expression levels relative to the indicated controls.

C-Circle Assay

The protocol for C-circle amplification was slightly modified from that published by Henson et al. (*Nat Biotechnol* 27(12):1181-1185, 2009). Briefly, genomic DNA was purified, digested with AluI and MboI and cleaned up by phenol-chloroform extraction and precipitation. DNA concentration was measured using a NANODROP™ and diluted in ultraclean water. Final template amount of 100, 50 or 25 ng was diluted to 10 μl with water and combined with 10 μl of 0.2 mg/ml BSA, 0.1% Tween detergent, 1 mM each dATP, dGTP, dTTP and 1×Φ29 Buffer (NEB) in the presence or absence of 7.5 U ΦDNA polymerase (NEB). Samples were incubated at 30° C. for 8 hours and then at 65° C. for 20 minutes. The reaction products were diluted to 100 μl with 2×SSC and dot-blotted onto a 2×SSC-soaked nylon membrane. DNA was UV cross-linked onto the membrane and hybridized with a $^{32}$P end-labelled (CCCTAA)$_4$ oligo probe (SEQ ID NO: 15). Blots were washed in 2×SSC and 1×SSC/0.1% SDS and exposed to PhosphorImager screens, scanned and quantified using a Typhoon 9400 PhosphorImager (Amersham/GE Healthcare).

Immunofluorescence and IF-Telomere FISH

For all immunofluorescence experiments, cells were grown on glass cover slips in 24-well plates. At the time of harvest the cells were washed twice with PBS and fixed with 2% paraformaldehyde in PBS for 10 minutes at room temperature. Following fixation, the cells were washed twice with MilliQ water and permeabilized with KCM buffer (120 mM KCL, 20 mM NaCl, 10 mM Tris pH 7.5 and 0.1% TritonX-100) for 10 minutes at room temperature. Cells were washed twice with PBS and stored at 4° C.

Fixed and permeabilized cells were incubated for 30 minutes in blocking buffer (PBS with 5% normal goat serum, Jackson ImmunoResearch cat #005-000-121), 0.3% fish skin gelatin (Sigma cat # G7765). Blocking buffer was removed and primary antibodies diluted in blocking buffer were added and incubated for 1 hour at room temperature. Primary antibodies were removed and the cells were rinsed quickly with PBS followed by 4, 5-minute washes in PBS. After the final wash, the cover slips were incubated with secondary antibody diluted in blocking buffer for 30 minutes. The cover slips were washed as before and counterstained with Hoescht DNA dye. Cells were rinsed with MilliQ water to remove excess salt and mounted with ProLong Gold antifade (Life Technologies cat # P36930). Mounted cover slips were left in the dark overnight at room temperature to allow for the mounting medium to cure, following which they were imaged on a Zeiss LSM 780 confocal microscope at 63× magnification.

For immunofluorescence combined with telomere FISH, cover slips were treated as described above with the following modifications. The initial 30 minute incubation in blocking buffer was carried out at 37° C. in the presence of 100 µg/mL RNaseA. Following the incubation with secondary antibody and washing in PBS, the coverslips were fixed in 2% paraformaldehyde for 10 minutes at room temperature then washed three times with MilliQ water. The cells were ethanol dehydrated by sequential incubation in 70% ethanol for 3 minutes, 90% ethanol for 2 minutes and 100% ethanol for 2 minutes and allowed to air dry for 15 minutes. Five µL of a 0.3 µg/mL stock of the Alexa488-PNA-TelC (PNA Bio cat # F1004) was spotted onto a clean glass slide and coverslips were placed cells side down onto PNA probe solution. The slide was heated was heated to 74° C. for 5 minutes then placed in a humidified chamber and allowed to hybridize overnight. Coverslips were washed 3 times for 5 minutes in PNA wash buffer A (70% formamide and 10 mM Tris pH 7.5), 3 times for 5 minutes in PNA wash buffer B (50 mM Tris pH7.5, 150 mM NaCl and 0.8% Tween-20) and then rinsed twice with MilliQ water. Hoescht was added to the second wash with PNA wash buffer B. Coverslips were air-dried and mounted using ProLong Gold.

Antibodies

PML (cat # ABD-030) was from Jena Bioscience and used at a 1:1000 dilution. ICP4 was tissue culture supernatant generated from the 58-S hybridoma clone from American Type Culture Collection (cat # HB-8183) and used at a 1:100 dilution. ASF1A (cat #2990) and ASF1B (cat #2769) were both from Cell Signaling Technology and used at 1:1000 dilution. HP1 antibody was from Upstate and used at a 1:100 dilution. Goat anti-mouse Alexa Fluor 488 (cat # A11029), goat anti-rabbit Alexa Fluor 555 (cat # A21429) and goat anti-mouse Alexa Fluor 647 (cat # A21236) were all from Life Technologies and used at a 1:1000 dilution.

Example 2: ALT-Dependent Replication of ICP0 Null HSV-1

This example describes the finding that ICP0-deficient HSV-1 selectively replicates in and kills ALT-dependent tumor cells.

Localization of HSV-1 Viral Genomes Resembles ALT Generated ECTRs

Figure 1B:
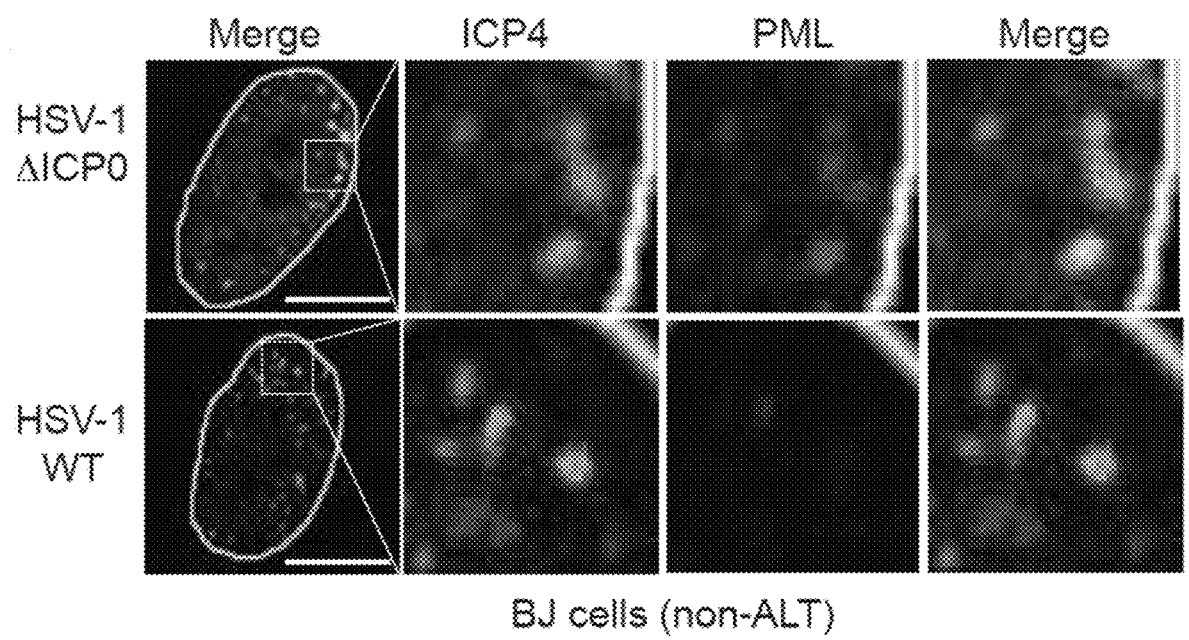

There is a striking overlap between the molecular targets of tumor mutations and DNA virus proteins (O'Shea, *Oncogene* 24, 7640-7655, 2005). Herpes simplex virus 1 (HSV-1) is an enveloped ~152 kbp double-strand linear DNA virus that undergoes lytic replication in a wide range of cell types (Knipe, D. M. & Howley, P. M. *Fields virology*. 6th edn, (Wolters Kluwer/Lippincott Williams & Wilkins Health, 2013). Early post-entry, the circularized viral genomes accumulate within PML nuclear bodies (PML NBs) along the periphery of the nuclear envelope. This accumulation is demonstrated by immunofluorescence for PML protein and the HSV-1 encoded ICP4 protein, which binds and marks viral genomes (FIGS. 1A and 1B). If left unchecked, this association results in the sequestration of viral genomes by PML NBs resulting in inhibition of viral replication and triggering of the expression of cellular genes that induce a protective antiviral and host immune response (FIG. 1A) (Everett et al., *J Virol* 80, 7995-8005, 2006; Boutell, *J Gen Virol* 94, 465-481, 2013). To prevent this, HSV-1 encodes a viral protein, ICP0, which degrades PML NBs as well as blocks the activation of downstream antiviral genes (FIG. 1B) (Boutell and Everett, *J Gen Virol* 94, 465-481, 2013).

Figure 1C:
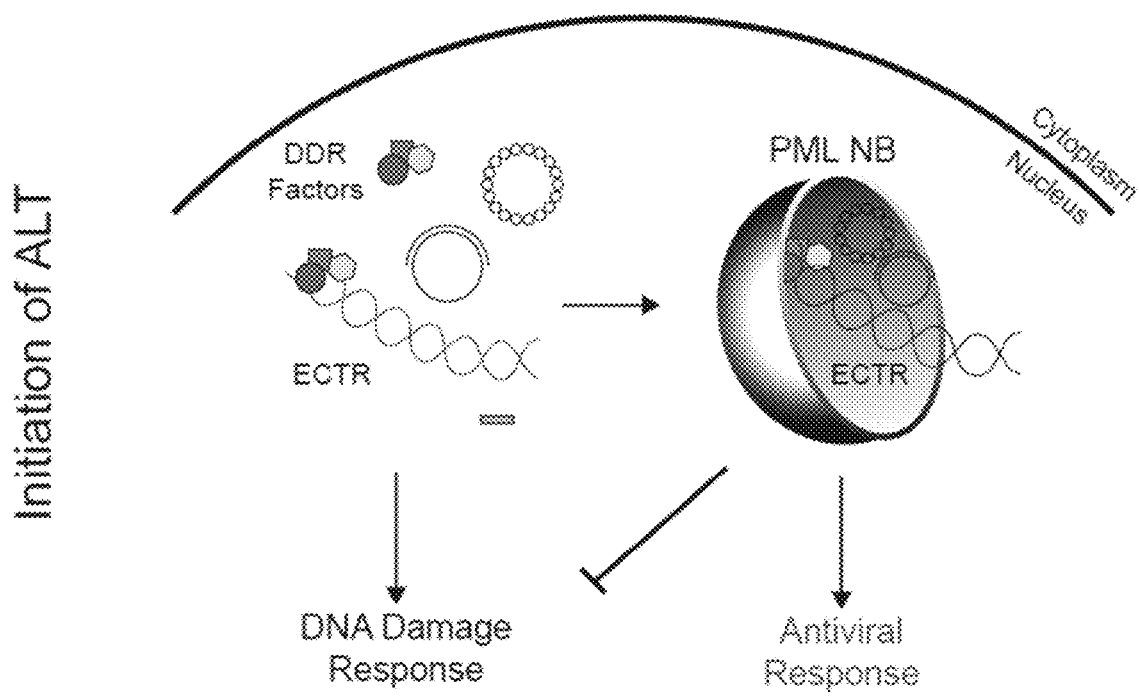
Figure 1D:
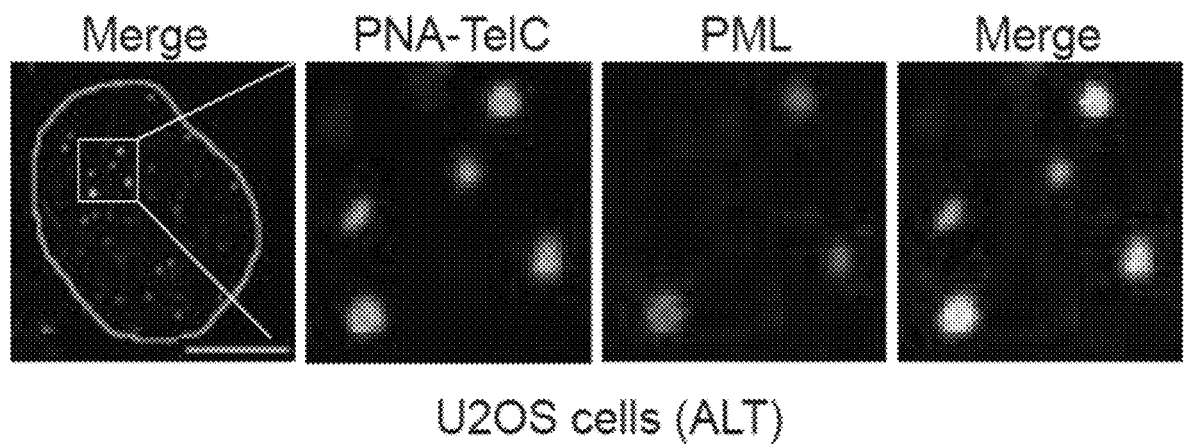
Figure 1E:
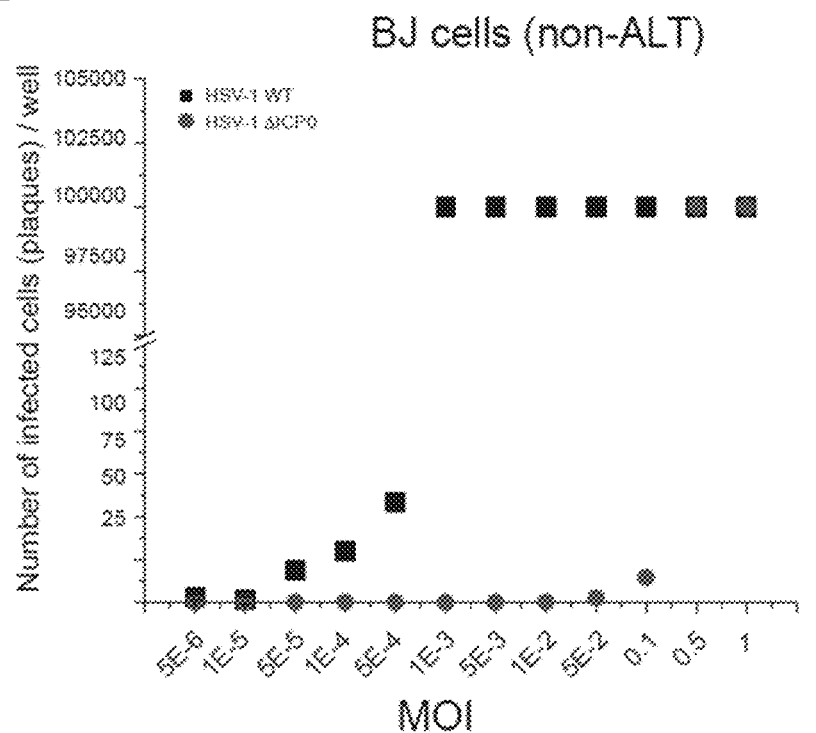
Figure 1F:
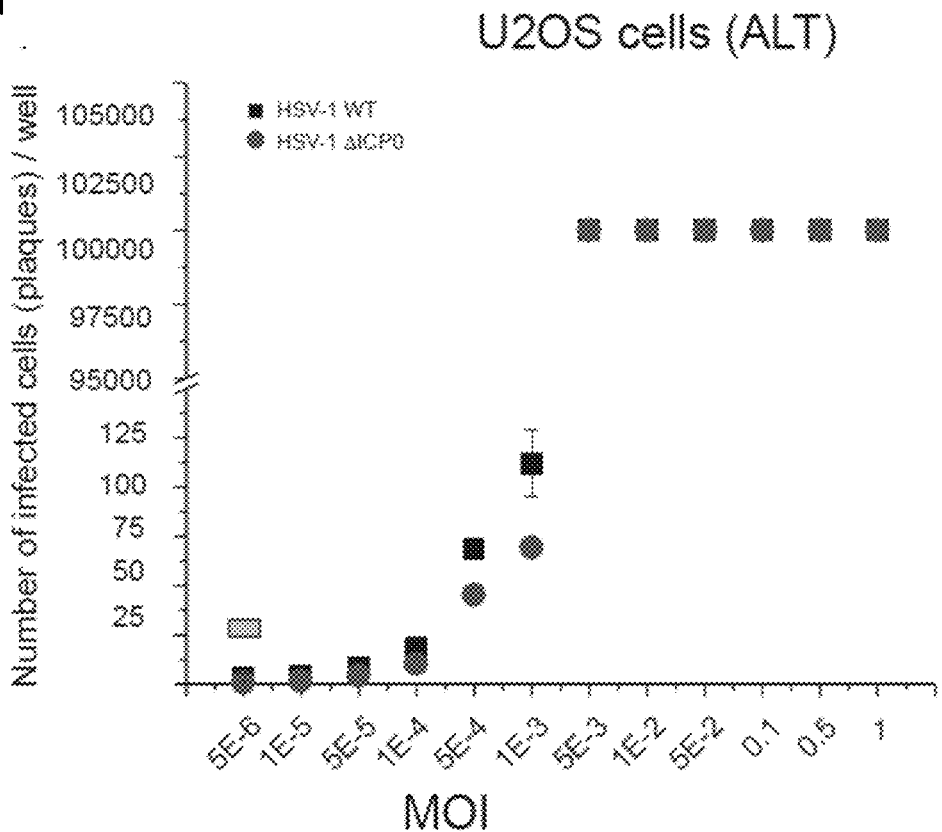

Mutant viruses that lack ICP0 (HSV-1 ΔICP0) are highly defective and exhibit ~1000-fold defect in replication efficiency in normal cells at low multiplicities of infection (MOI) as measured by plaque assay (FIG. 1E). This defect in replication can be overcome at high MOI, suggesting the restriction is saturable (FIG. 1E). Furthermore, it has been observed that an ICP0 deleted virus replicates to wild-type levels in the U2OS osteosarcoma derived cell line at low MOI (FIG. 1F) (Yao and Schaffer, *J Virol* 69, 6249-6258, 1995). This indicates that potential restriction factor(s) may have been lost in these cells during transformation. The loss of critical HSV-1 specific restriction factors is further supported by somatic cell hybridization experiments in which lytic replication of HSV-1 ΔICP0 is inhibited after U2OS are fused with the non-permissive HEL fibroblasts (Hancock and Corcoran, *Virology* 352, 237-252, 2006). However, it is unknown what those factor(s) are and why U2OS cells rescue replication of HSV-1 ΔICP0 back to wild type levels.

It was hypothesized that the rescue of HSV-1 ΔICP0 replication by U2OS cells is due to the use of ALT as the primary telomere maintenance mechanism in these cells. Although the molecular understanding of ALT is currently limited, there are two defining characteristics of ALT that bare striking resemblance to HSV-1 infection. First, telomere maintenance via ALT generates a large amount of extrachromosomal telomeric repeat (ECTR) DNA. This DNA is highly repetitive and present in the nucleus as double-stranded linear, double-stranded circular as well as partially double-stranded circular forms (FIG. 1C) (Nabetani and Ishikawa, *Mol Cell Biol* 29, 703-713, 2009; Henson et al., *Nat Biotech* 27, 1181-1185, 2009). Second, together with telomeres, ECTRs accumulate in and co-localize with PML NBs to form ALT-associated PML NBs (APBs) (Yeager et al., *Cancer Res* 59, 4175-4179, 1999). APBs are typically present in 5% of asynchronously dividing ALT (Yeager et al., *Cancer Res* 59, 4175-4179, 1999) cells and can be visualized via immunofluorescence of cells using ALT, such as U2OS, stained for PML and a PNA-TelC FISH probe (FIG. 1D). Traditionally they have been characterized by their large size (>1 µM) and the presence of telomere interacting proteins and DNA damage response proteins in addition to telomeres and ECTRs (Chung et al., *Nucleus* 3, 263-275, 2012). However, a few groups have reported the presence of smaller APBs in 50-90% of asynchronously dividing ALT cells (Nabetani et al., *J Biol Chem* 279, 25849-25857, 2004; Osterwald, *Biotechnol J7*, 103-116, 2012).

The current model of ALT suggests that PML NBs facilitate telomere maintenance as well as sequesters ECTRs. It has been proposed that the sequestration of ECTRs by PML NBs prevents the ends of the linear double strand DNA ECTRs from being recognized as double strand breaks activating a deleterious DNA damage response (FIG. 1C) (Chung et al., *Nucleus* 3, 263-275, 2012). However, this model assumes accumulation of ECTRs in PML NBs is inert and fails to address the potential long-term impact that such an accumulation of DNA would have on the normal functions of PML NBs. Notwithstanding, the association of ECTRs with PML NBs presents an intriguing convergence with viral infection and detection of their genomes.

Under normal conditions, organization of these bodies is dependent on PML. In addition to PML a myriad of other proteins have been reported to localize to these nuclear domains, such as ATRX, DAXX and SP100. Typically, 1-30 PML NBs, depending on cell type and phase of the cell cycle, are observed at the inter-chromatin space (Bernardi and Pandolfi, *Nat Rev Mol Cell Biol* 8, 1006-1016). There, PML NBs act as hubs regulating chromatin organization, transcription (activation and repression), sequestration of foreign DNA, DNA repair, cytokine and interferon signaling, and senescence among many other diverse cellular processes (Bernardi and Pandolfi, *Nat Rev Mol Cell Biol* 8, 1006-1016; 2007; Sahin et al., *J Pathol* 234, 289-291, 2014; Maarifi et al., *Cytokine Growth Factor Rev* 25, 551-561, 2014; Batty et al., *Front Biosci* 14, 1182-1196, 2009). Since PML NBs are at the nexus of telomere maintenance via ALT and HSV-1 infection and present in limited number, it was hypothesized that the association of telomeres and ECTRs with PML NBs could saturate their capacity to sequester extrachromosomal DNA. This would in essence render PML NBs blind to incoming HSV-1 viral genomes at low MOI. If true, one would expect that in ALT cells, such as U2OS, incoming viral genomes would be free from the constraints and sequestration imposed on them by PML NBs. From this two testable predictions arise: disruption of PML NBs in a non-ALT cell should rescue replication of HSV-1 ΔICP0, and incoming viral genomes would fail to localize with PML NBs in an ALT cell.

Figure 5A:
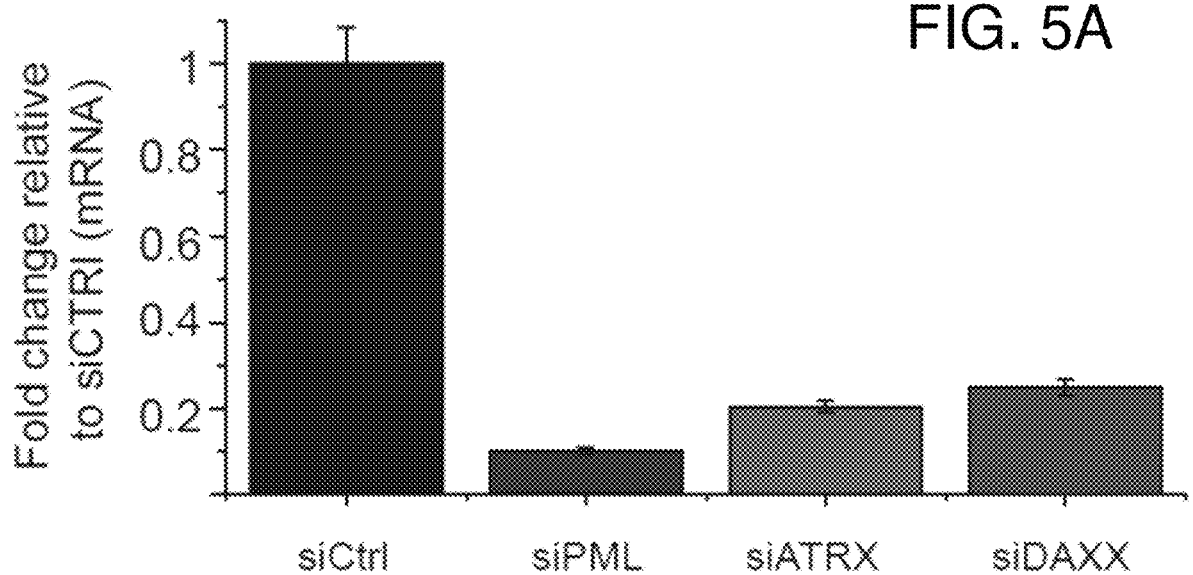
FIGS. 5A-5B.
Figure 5B:
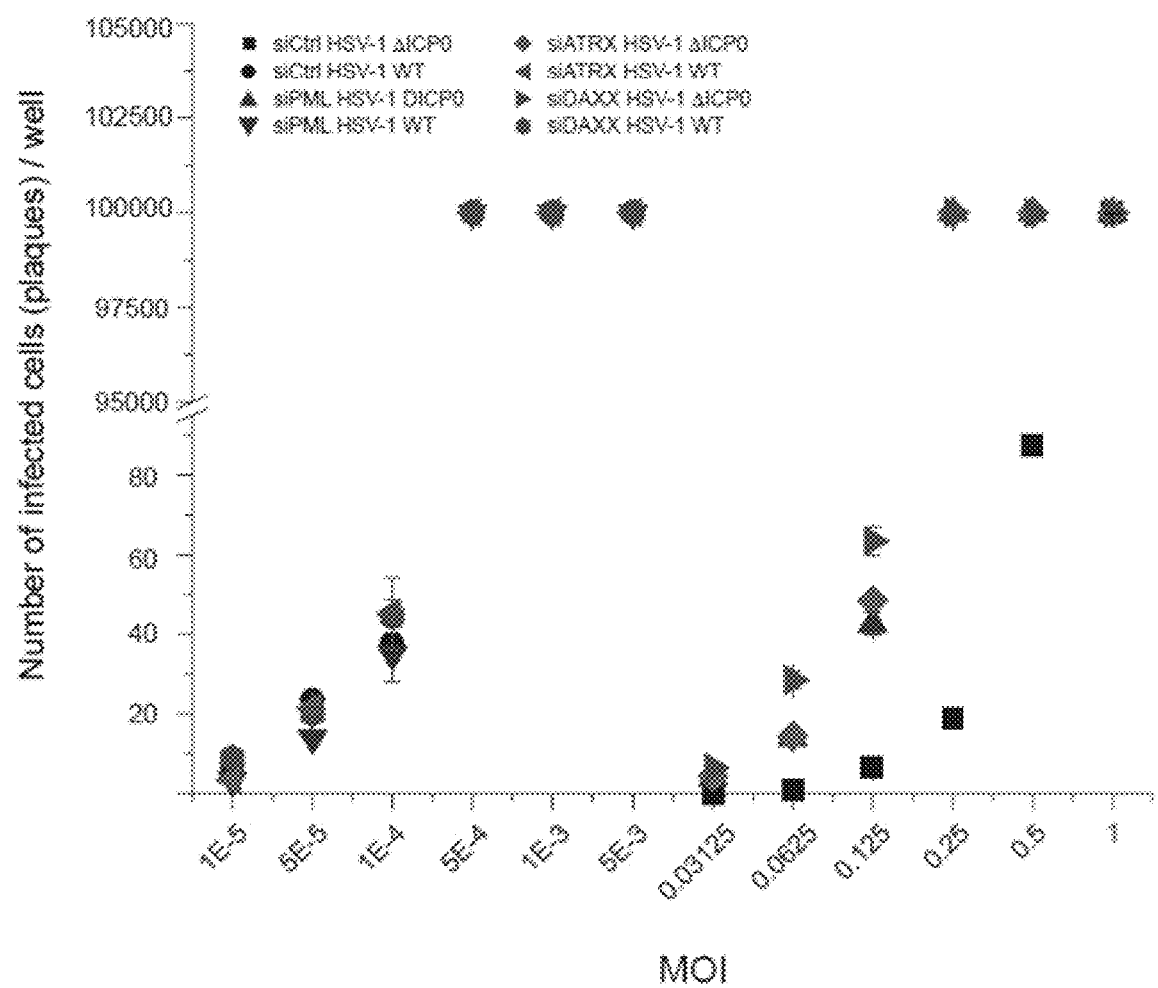

Using RNAi, PML NBs were disrupted by knocking down PML, ATRX or DAXX in BJ fibroblasts (non-ALT) (FIG. 5A). Lytic replication of HSV-1 WT or ΔICP0 was then measured by plaque assay in the presence of the knockdown and compared to lytic replication efficiency in BJ cells that received control siRNA. In agreement with previous reports (Everett et al., *J Virol* 80, 7995-8005, 2006; Lukashchuk, *J Virol* 84, 4026-4040, 2010; Boutell, *J Gen Virol* 94, 465-481, 2013), disruption of the PML NB via knockdown of its individual components resulted in only a modest, 5- to 10-fold rescue in replication of an ICP0 deleted HSV-1 virus (FIG. 5B). Although others have shown that simultaneous knockdown of various components of PML NB such as PML, Sp100 and DAXX yields nearly a 100-fold rescue in lytic replication of HSV-1 ΔICP0 in non-permissive cells (Glass and Everett, *J Virol* 87, 2174-2185, 2013), this is still far short of the 1000-fold defect in lytic replication seen in primary cells when compared to WT HSV-1 (FIG. 1E). This indicates that although PML NBs play a role in suppression of HSV-1 ΔICP0 lytic replication, there are other cellular factors that contribute to the suppression of HSV-1 ΔICP0. Furthermore, U2OS cells have likely acquired multiple mutations that result in the rescue of lytic replication of an ICP0 deleted HSV-1 virus back to wild type levels.

Figure 1G:
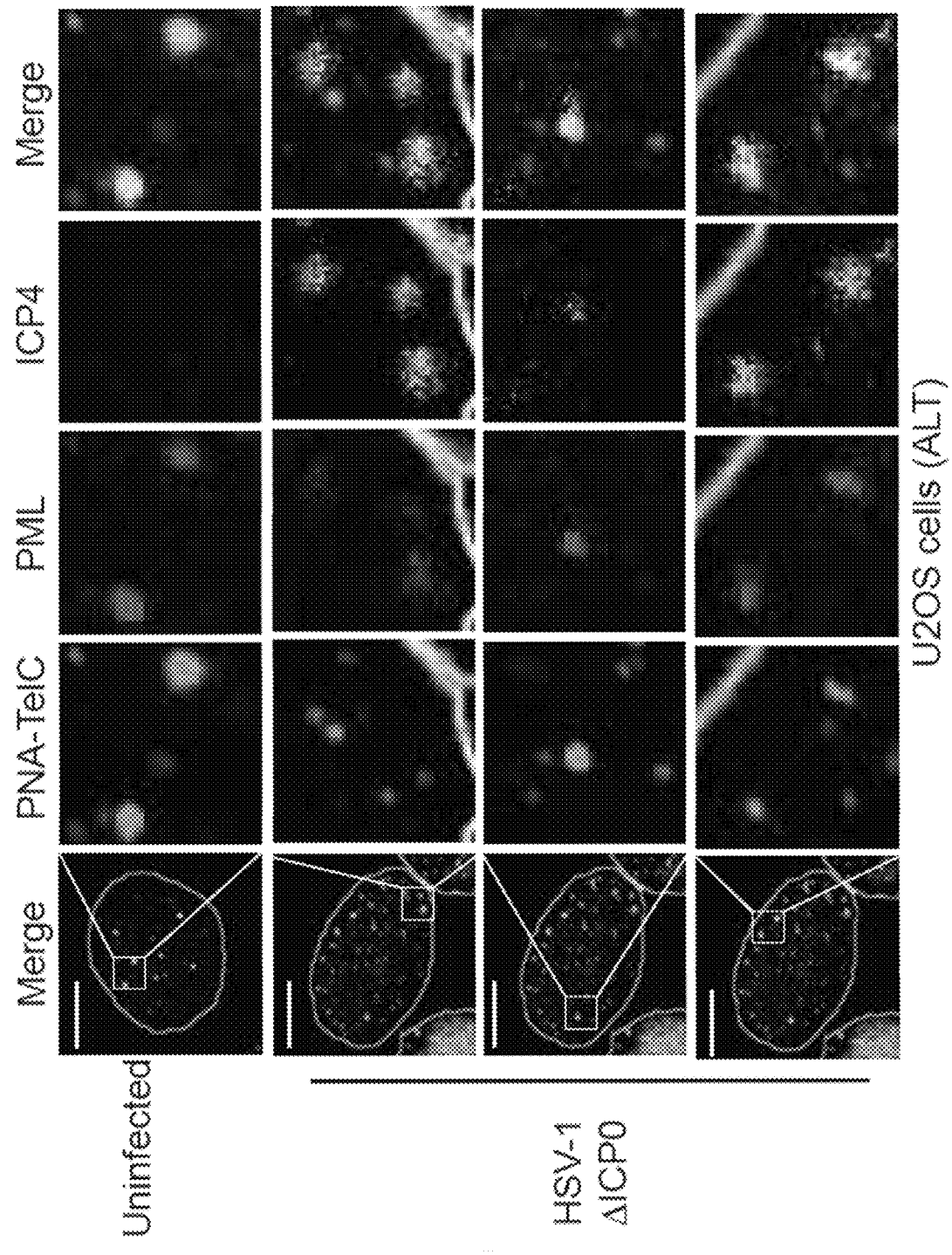

While these data demonstrate that PML NBs are in part responsible for the restriction of HSV-1 replication, they do not delineate between restriction due to sequestration and/or restriction due to modification of the viral genome by PML NBs. It was reasoned that if sequestration of HSV-1 viral genomes is sufficient to suppress lytic replication of an ICP0 deleted virus in U2OS cells, then one would expect a lack of co-localization between PML NBs and HSV-1 viral genomes. When immunofluorescence was performed for PML, ICP4 and PNA-TelC in U2OS cells, along the edge of plaques it was observed that viral genomes still associate with PML NBs (FIG. 1G). In addition, association between telomeric repeat DNA and PML NBs in infected U2OS cells was observed, and in some cases, viral genomes, telomeric repeat DNA and PML NBs all co-localized. Taken together, these data indicate that the presence of ECTRs and APBs does not prevent the association of PML NBs with incoming viral genomes. This indicates that the association of HSV-1 viral genomes with PML NBs is not sufficient to restrict HSV-1 replication but that additional modifications to the viral genome or activation of downstream signaling events is required for restriction of lytic replication at low MOI by PML NBs.

Cells that Use ALT for TMM Fail to Transcriptionally Respond to HSV-1 Infection

Because HSV-1 genomes co-localize with PML NBs in U2OS cells with no adverse effect on viral lytic replication, yet co-localization in non-ALT cells results in restriction, it was reasoned that a fundamental change in the PML NB has occurred in U2OS cells. Furthermore, since disruption of PML NBs via RNAi fails to restore replication of an ICP0 deleted virus back to wild type levels, it suggests that U2OS cells may harbor additional alterations that alleviate restriction of HSV-1 ΔICP0 lytic replication. In addition to the disruption of PML NBs, ICP0 is a potent transactivator of both viral and cellular gene expression during HSV-1 infection (Everett, *EMBO J* 3, 3135-3141, 1984). It was hypothesized that changes to the cellular transcriptional program upon infection may cooperate with PML NBs to restrict HSV-1 ΔICP0 lytic replication. Loss or alterations to both the PML NBs and cellular transcriptional program in U2OS cells may explain the rescue of lytic replication of an ICP0 deleted HSV-1 virus observed in these cells.

Figure 2A:
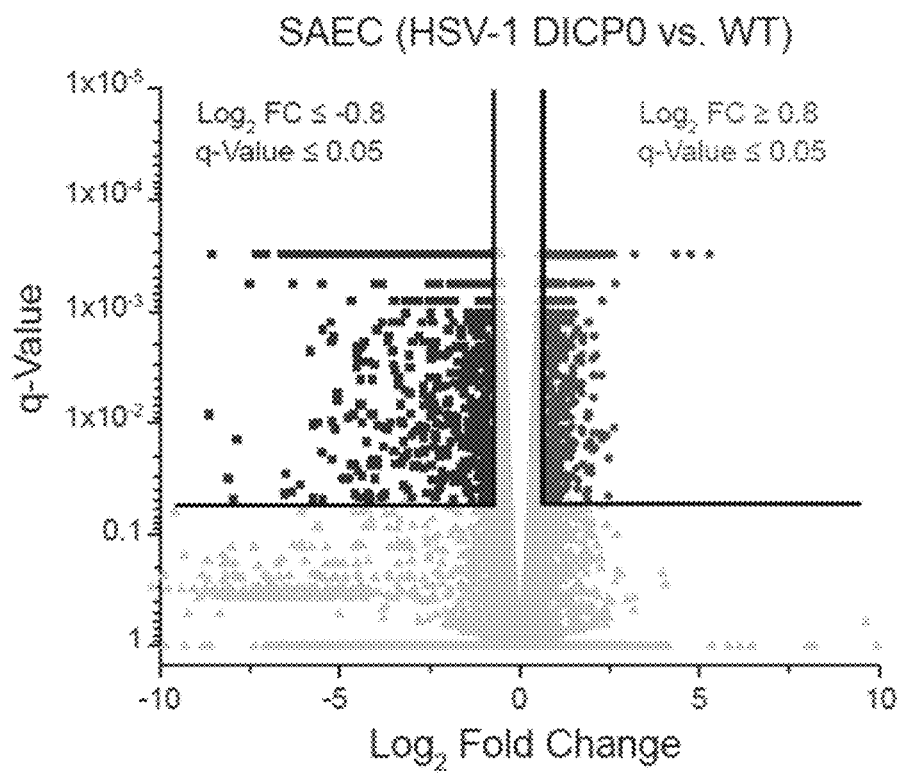
FIGS. 2A-2J.
Figure 2B:
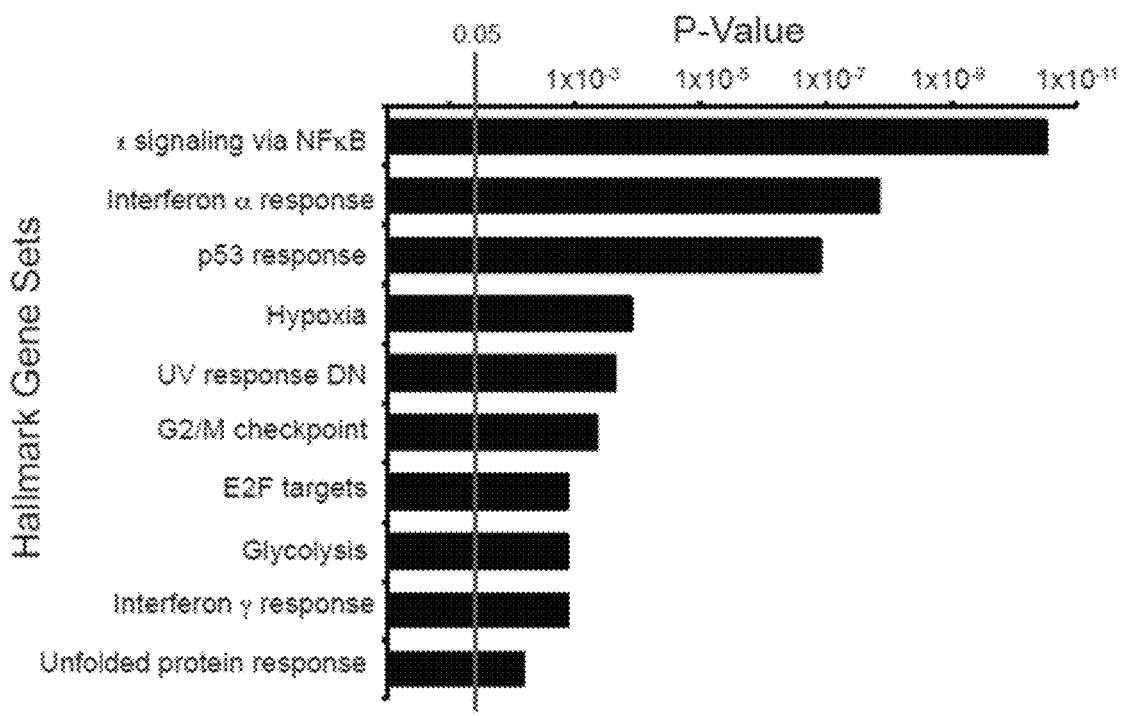
Figure 2C:
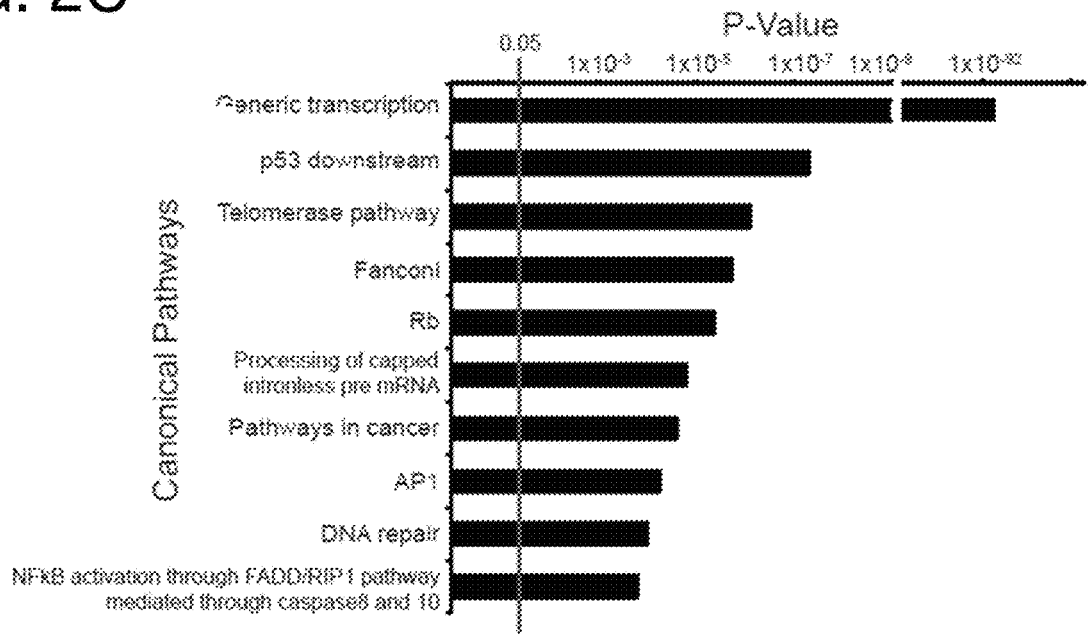

In order to define the ICP0 induced cellular transcriptional program during HSV-1 infection, a series of RNA-seq and microarray experiments were performed. Since tumor derived cell lines carry large numbers of mutations that may convolute downstream gene expression analysis and potentially affect HSV-1 infection, normal primary small airway epithelial cells (SAEC) were used to obtain a baseline gene expression profile to which all subsequent gene expression profiles would be compared. SAEC were infected with HSV-1 WT or HSV-1 ΔICP0 and total RNA was collected at 8 hours post-infection (hpi). Significantly differentially expressed genes between SAEC infected with HSV-1 ΔICP0 vs SAEC infected with HSV-1 WT were determined using a threshold q-value≥0.05 and a Log 2 fold change≥0.8 or ≤−0.8 (FIG. 2A). By these criteria, 1047 cellular genes were transcriptionally activated (blue) and 1259 cellular genes were transcriptionally suppressed (red) by ICP0 in the context of HSV-1 infection (FIG. 2A). Those genes suppressed by ICP0 (red) were subjected to a hypergeomteric test using the Molecular Signatures Database (MSigDB) in order to calculate overlap with the hallmark gene set. Those genes suppressed by ICP0 showed a significant overlap with genes that are upregulated in response to pro-inflammatory and interferon stimuli. Additionally, downstream targets of p53, cell cycle regulators such as E2F targets and components of the G2/M checkpoint, as well as genes down-modulated in response to UV, were all suppressed by ICP0 during HSV-1 infection (FIG. 2B). A similar analysis in MSigDB using the curated pathways gene sets, which includes canonical signaling pathways from Biocarta, Kegg, Reactome among others, revealed a significant overlap between ICP0 suppressed genes and genes involved in the regulation of telomerase activity (FIG. 2C). Taken together these data begin to assemble a gene signature established during infection that has elements that overlap with pro-inflammatory, interferon, cell cycle, DNA damage signatures as well as telomere maintenance, all of which cooperate to prevent HSV-1 lytic replication in the absence of ICP0.

Figure 2D:
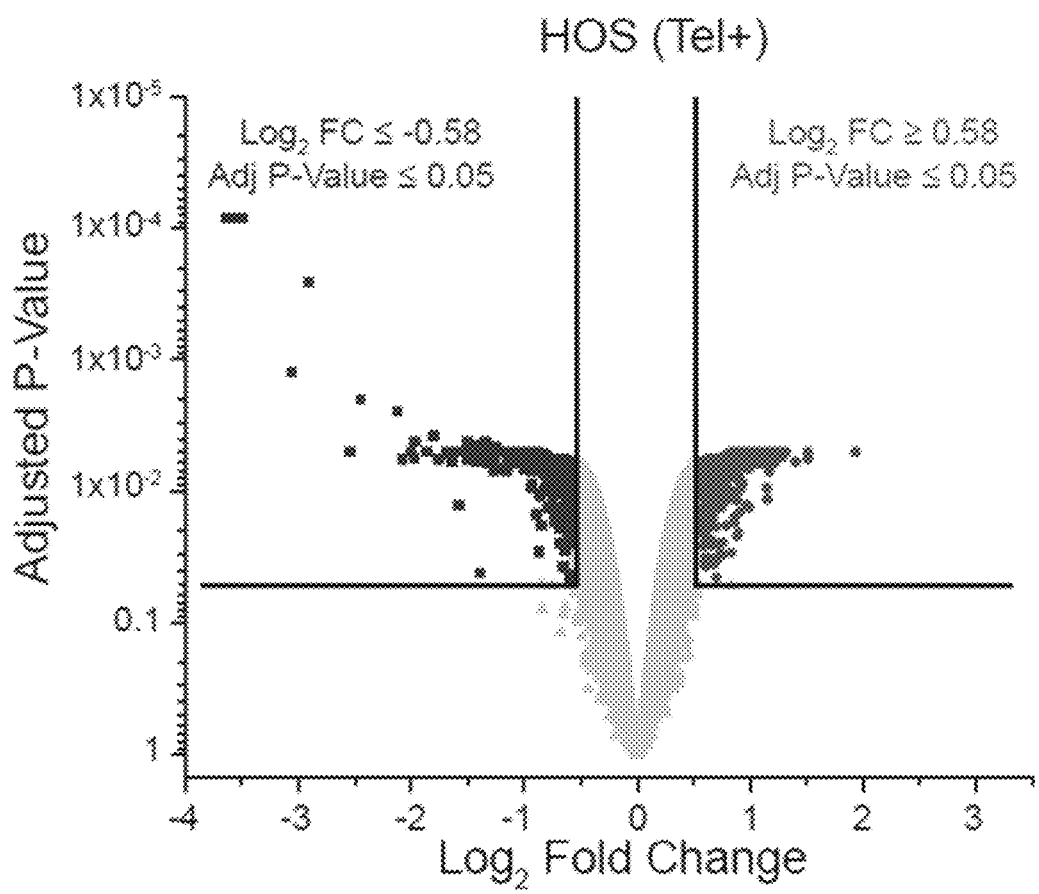
Figure 2E:
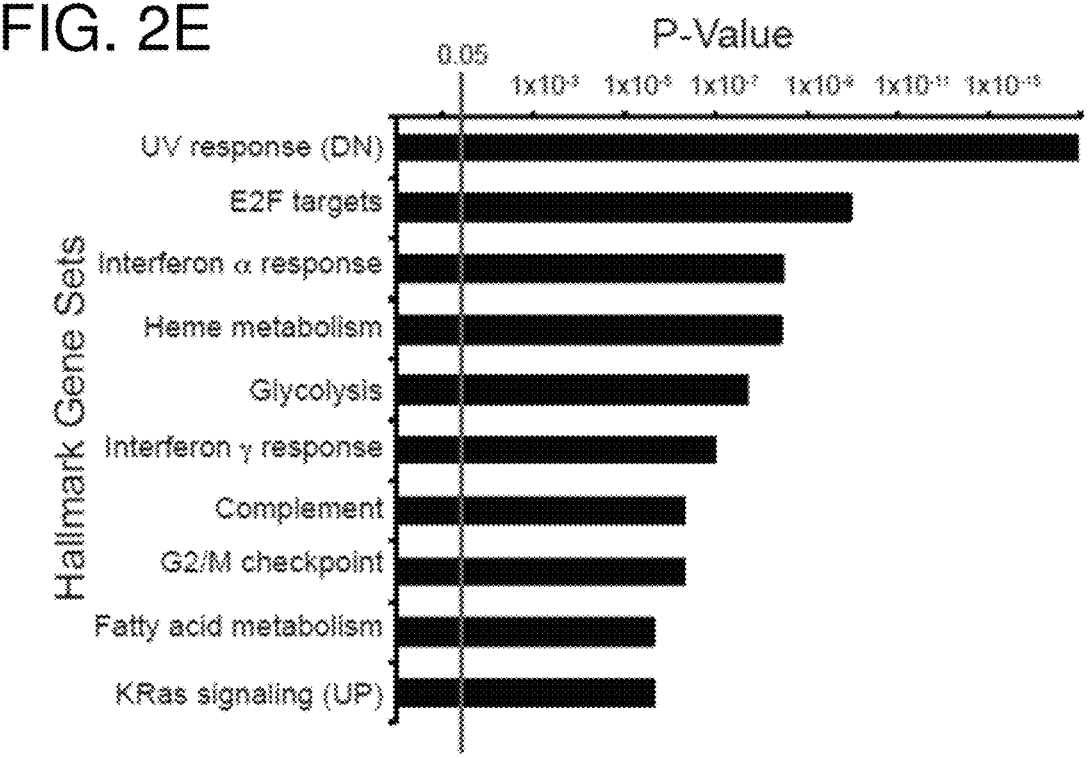

It was reasoned that comparing the cellular transcriptional program established by ICP0 in normal primary SAEC to the cellular transcriptional program established by ICP0 in permissive U2OS cells would allow identification of those genes or pathways that cooperate with PML NBs to restrict an ICP0 deleted HSV-1 virus. Furthermore, it was believed these studies could provide further insights into how this signature is altered not only in U2OS cells but also in other cell types that use ALT to maintain telomere length. To this end, U2OS cells were infected with HSV-1 WT or HSV-1 ΔICP0 virus and RNA was collected at 12 hpi, which was subjected to gene expression analysis on an affymetrix GeneChip human gene ST 1.0 microarray. Significantly differentially regulated genes were determined using an adjusted p-value≥0.05 and Log 2 fold change≥0.8 or ≤−0.8 (FIG. 2D). In striking contrast to 2306 differentially regulated genes in SAEC infected cells, 139 genes were transcriptionally activated and only 31 genes were transcriptionally suppressed by ICP0 in U2OS cells in the context of HSV-1 infection. Moreover, when ICP0 suppressed genes from SAEC and U2OS were compared, they exhibited very little overlap, indicating that those genes that are differentially regulated in U2OS are not likely to contribute to the restriction of HSV-1 ΔICP0 (FIG. 2E). Given the small number of genes differentially regulated between HSV-1 ΔICP0 and HSV-1 WT in U2OS cells, coupled with the observed rescue of HSV-1 ΔICP0 lytic replication in these cells suggests that the transcriptional program established by ICP0 during HSV-1 infection in SAEC is genetically phenocopied in U2OS cells. In addition, somatic cell hybridization experiments have demonstrated that the rescue of HSV-1 ΔICP0 lytic replication in U2OS is likely to due to the loss of one or more cellular restriction factors (Hancock et al., Virology 352, 237-252, 2006). This argues that genes or pathways suppressed by ICP0 during HSV-1 infection are the critical factors that act to restrict viral replication and not the ICP0 transcriptionally upregulated genes.

PML NBs exhibit anti-viral activity towards HSV-1 as well as several other viruses (Everett, Oncogene 20, 7266-7273, 2001). Given the atypical presence of ECTR DNA in ALT cells that associates with and is sequestered by PML NBs, similar to HSV-1 viral genomes, it was hypothesized that the ECTRs may also trigger other anti-viral pathways. Since these pathways would be restrictive to both viral replication and cell growth they would have to be turned off or down-modulated during transformation and the transition to ALT. If true, then this would explain the lack of activation of the restrictive transcriptional profile in U2OS cells that is observed in HSV-1 ΔICP0 infected SAEC (FIG. 2). In addition, if an anti-viral state is initiated in cells transitioning to ALT, which must then be lost, then other cells or tumors that use ALT should also fail to activate the restrictive transcriptional profile upon infection with HSV-1 ΔICP0.

Figure 2F:
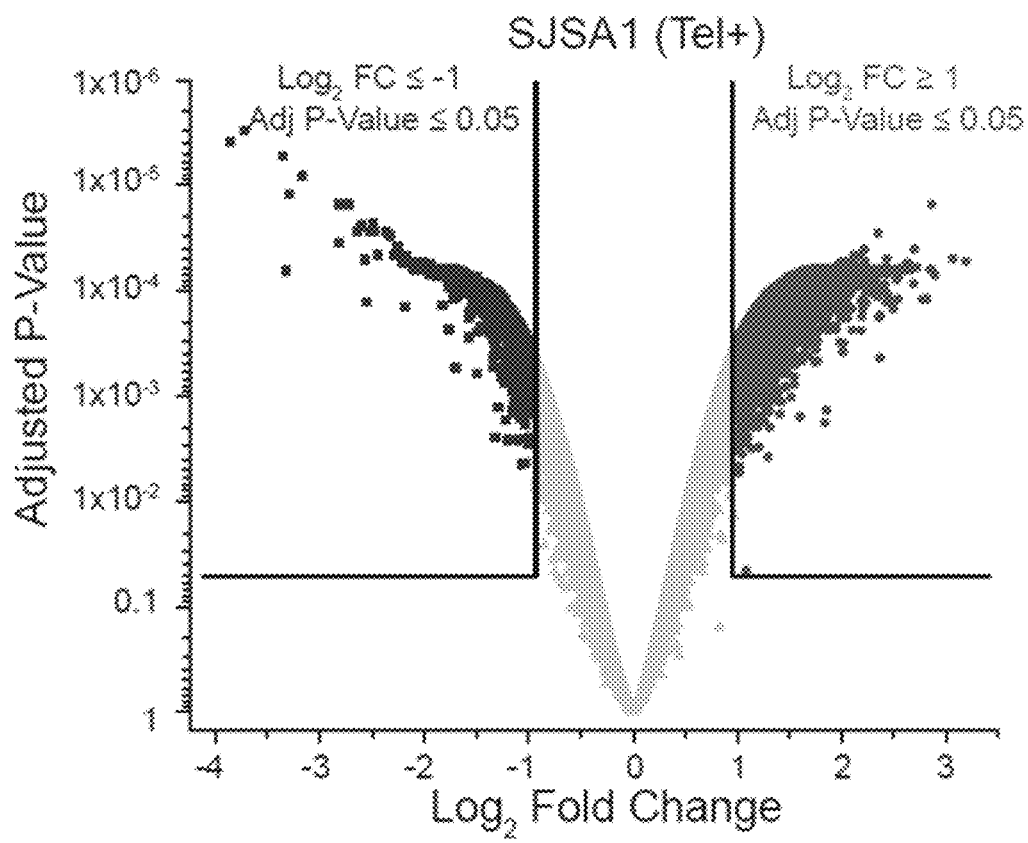
Figure 2G:
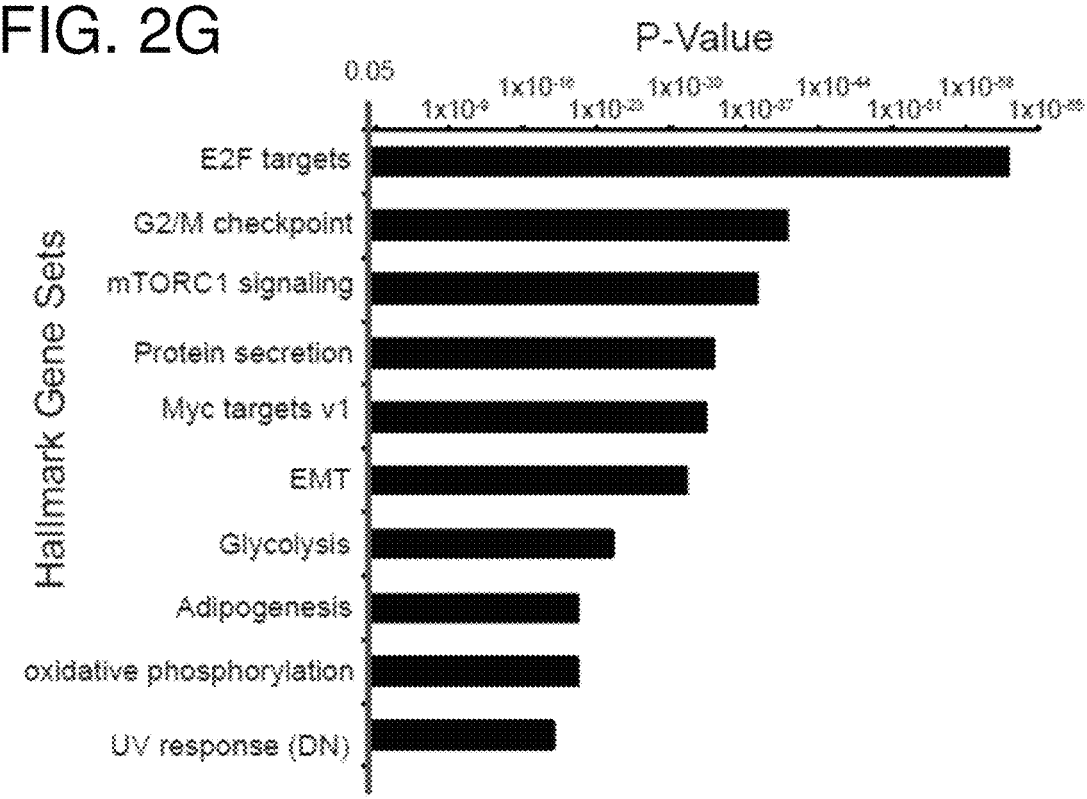
Figure 2H:
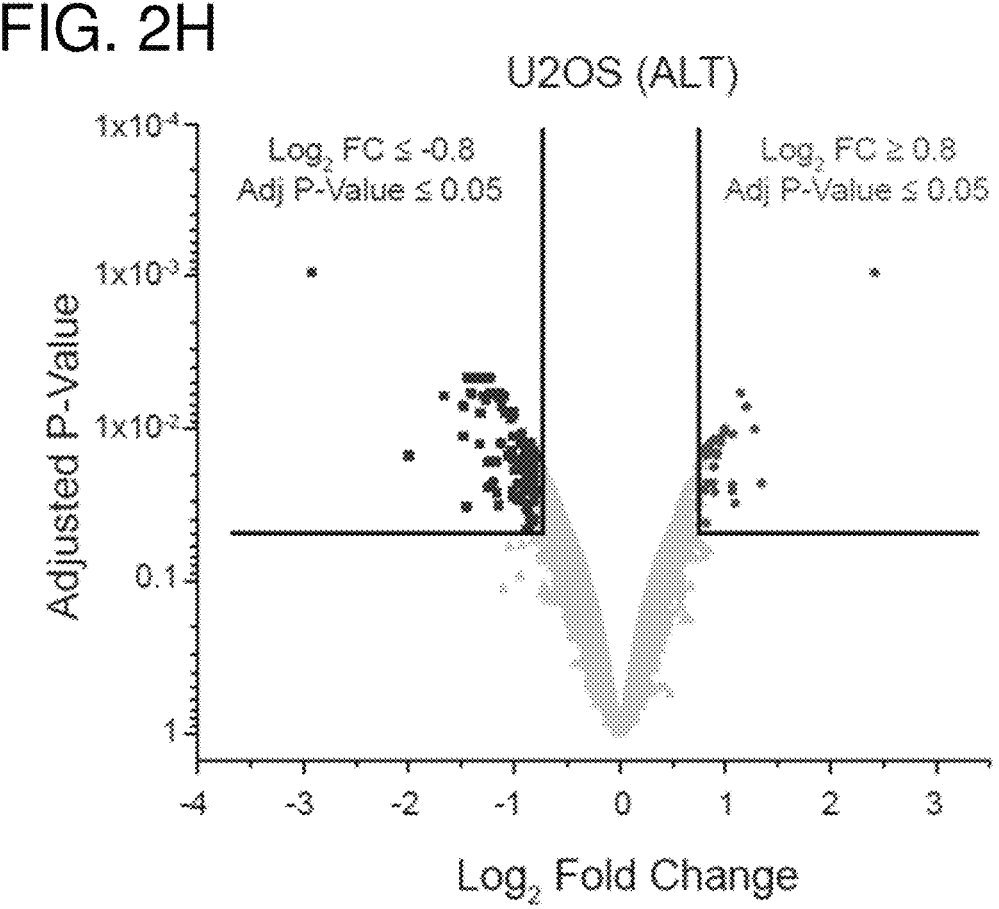
Figure 2I:
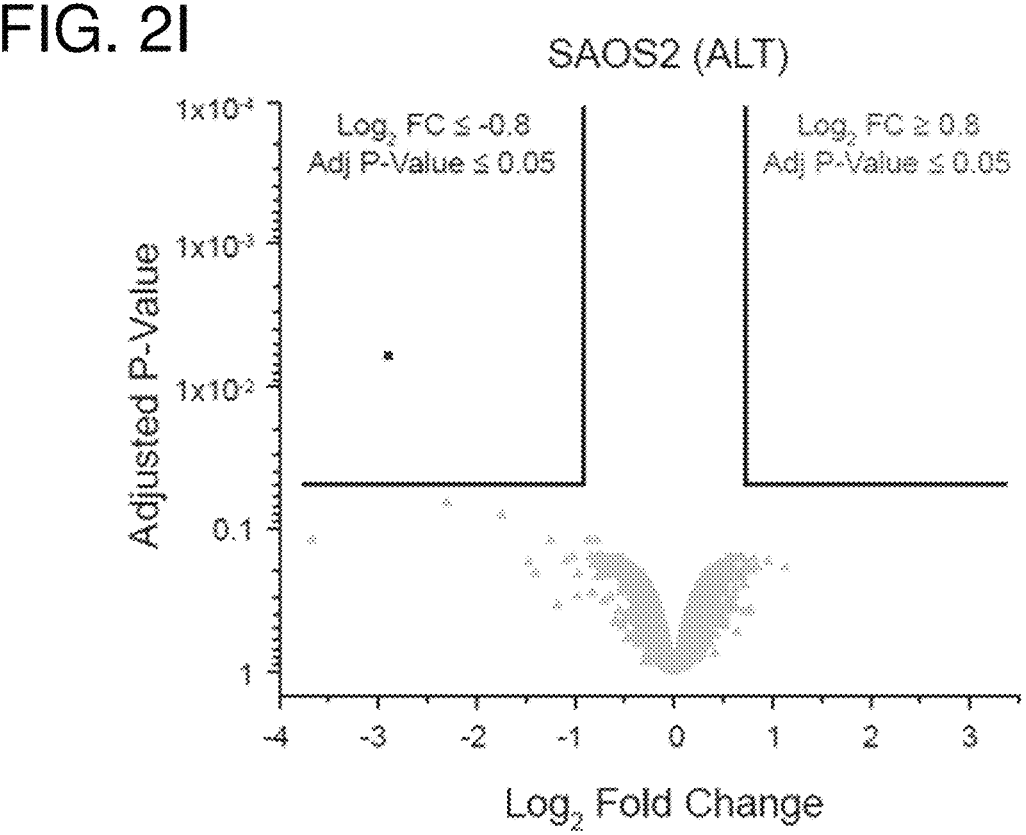
Figure 2J:
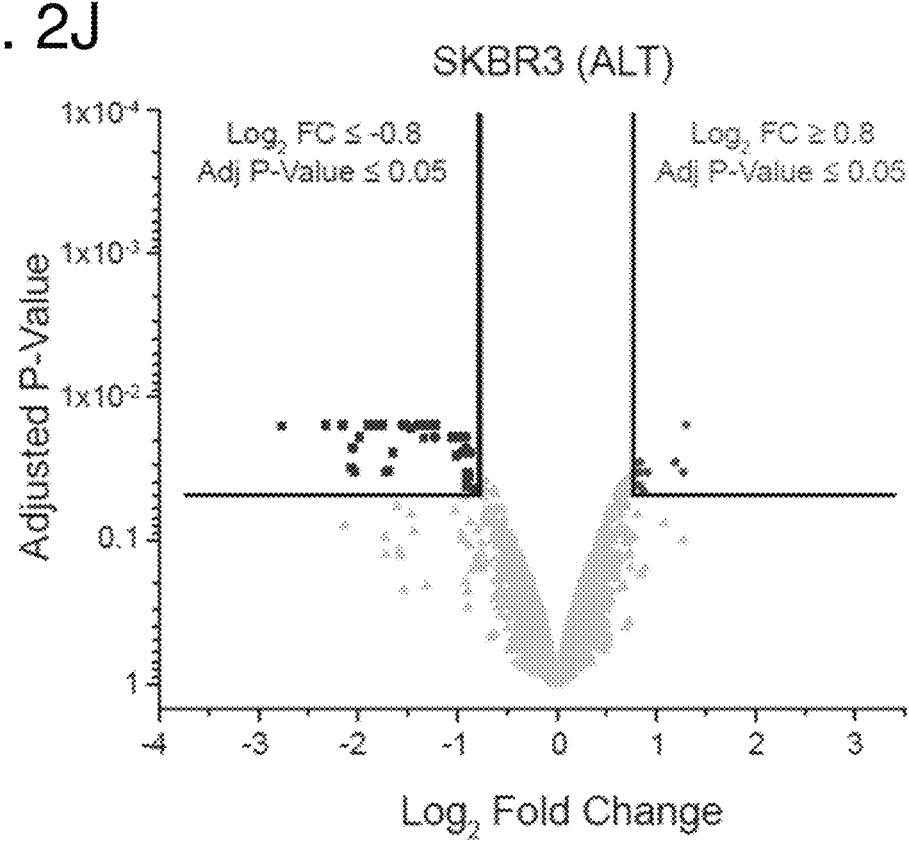

Total RNA from either the osteosarcoma derived cell line SAOS2 or the breast cancer derived cell line SKBR3 infected with either HSV-1 WT or HSV-1 ΔICP0 was prepared and analyzed by microarray as described above. Applying the same thresholds used for SAEC and U2OS, only 1 gene was significantly differentially expressed between SAOS2 HSV-1 ΔICP0 infected cells and SAOS2 HSV-1 WT infected cells (FIG. 2F). A similar analysis of SKBR3 HSV-1 ΔICP0 infected cells compared to SKBR3 HSV-1 WT infected cells showed only 47 ICP0 transcriptionally activated genes (blue) and 10 ICP0 transcriptionally suppressed genes (red) (FIG. 2G). This further supports the hypothesis that the transition to ALT leads to the inability of these cells to mount an appropriate restrictive anti-viral response.

In contrast, tumor derived cell lines that use telomerase as their preferred telomere maintenance mechanism (TMM) should behave more similar to the normal primary SAEC cells and activate a similar restrictive anti-viral transcriptional response when infected with HSV-1 ΔICP0 compared to HSV-1 WT. The telomerase-positive osteosarcoma derived cell lines HOS and SJSA1 were infected with either HSV-1 ΔICP0 or HSV-1 WT virus as above and RNA was harvested for gene expression analysis by microarray. Significantly differentially regulated genes were determined using an adjusted p-value≥0.05 and Log 2 fold change≥0.58 or ≤−0.58 for HOS cells and Log 2 fold change≥1 or ≤−1 for SJSA1. The results demonstrated that 1564 genes were differentially regulated in HOS and 4265 in SJSA1 cells with 1120 genes in HOS and 3359 genes in SJSA1 being transcriptionally suppressed by ICP0. Furthermore, when the overlap between the ICP0 transcriptionally suppressed genes was computed using the hallmark gene sets from MSigDB (as described above), there was an overlap with many of the same gene sets observed when the same analysis was performed on the SAEC expression data. There is a loss in some aspects of the inflammatory and interferon signaling gene sets from both the HOS and SJSA1 expression data sets when compared to SAEC. However, this is not too surprising since tumor cells in general have been reported to be less responsive to interferon signaling and establishment of an anti-viral state (Hummel et al., Mol Ther 12, 1101-1110, 2005). Furthermore, since tumor cells tend to be more permissive to replication of HSV-1 ΔICP0, regardless of TMM, when compared to normal primary cells it is possible that a partial loss of the anti-viral transcriptional program as seen here may account for this partial rescue. Taken together, these data demonstrate that cells that use ALT fail to respond and initiate an anti-viral transcriptional response as seen in normal primary SAEC as well as telomerase positive tumor cell lines.

Figure 3A:
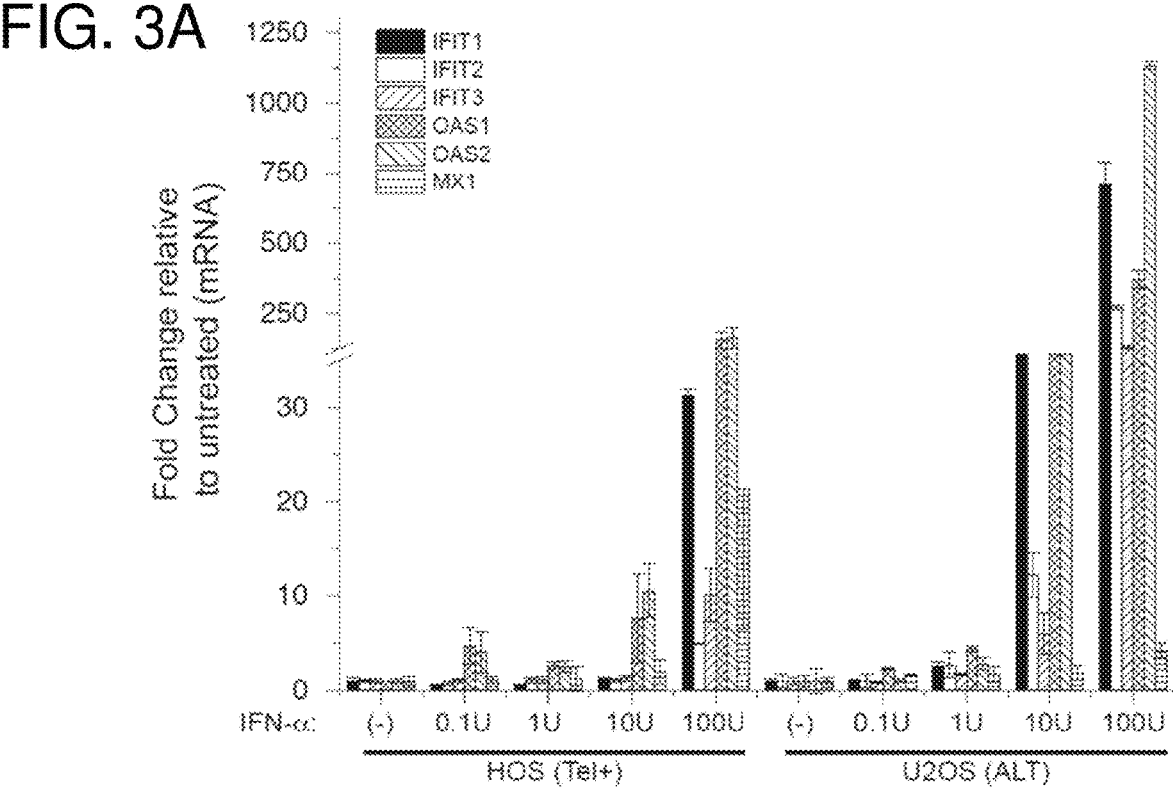
FIGS. 3A-3D.
Figure 6A:
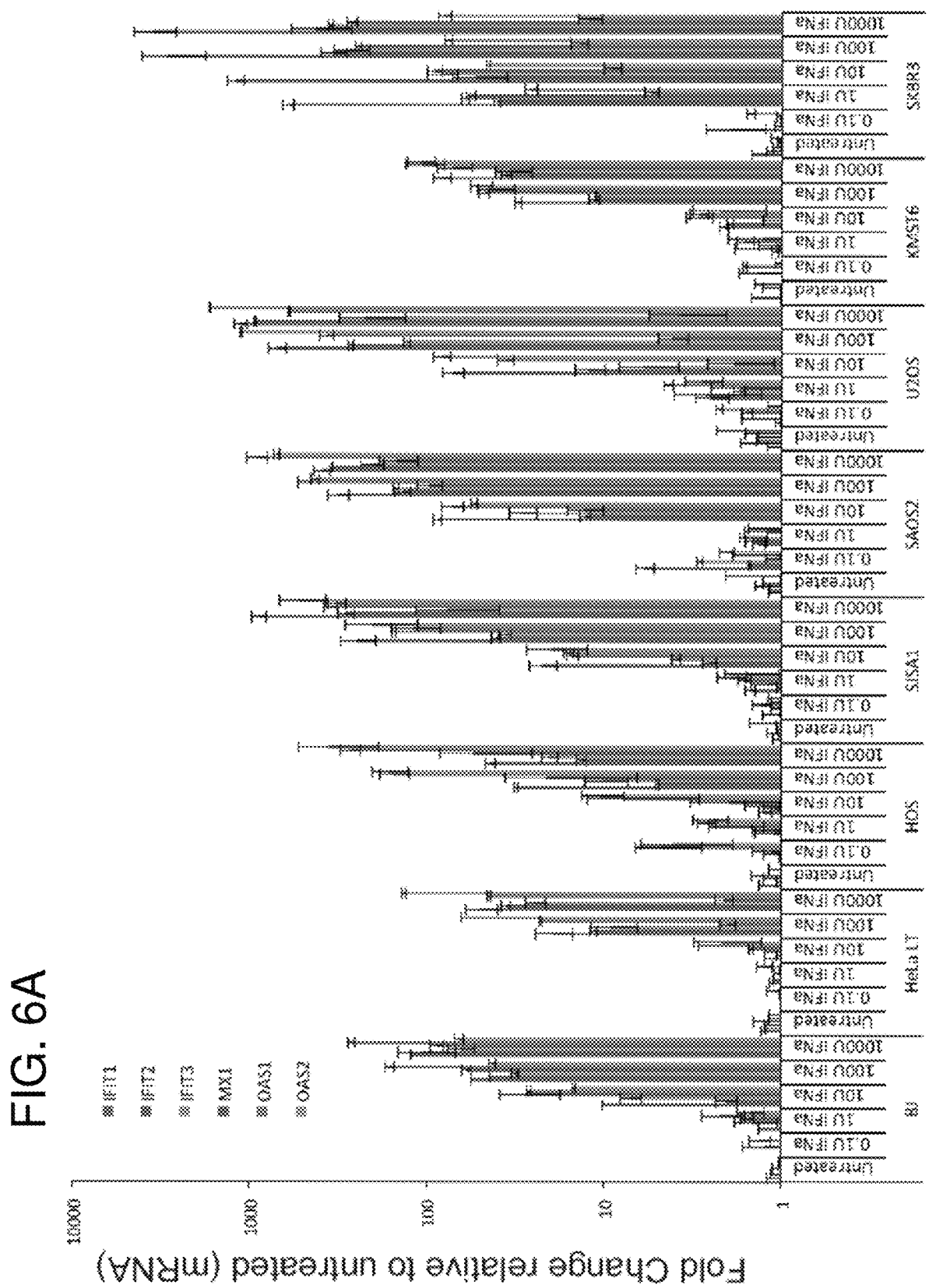
FIGS. 6A-6B.

ALT Cells Fail to Initiate Anti-Viral Response when Challenged by Intracellular DNA The data described herein predicts that ALT cells should have a diminished capacity to transcriptionally upregulate interferon stimulated genes (ISG) in response to pathogenic stimuli. Activation of ISGs can occur through extrinsic initiated or intrinsic initiated pathways (Ivashkiv and Donlin, Nat Rev Immunol 14, 36-49, 2014; Schneider, Annu Rev Immunol 32, 513-545, 2014). To test whether the preferred TMM of a cell influences its ability to initiate an appropriate transcriptional response via the extrinsic pathway, a panel of ALT and non-ALT cell lines were treated with varying amounts of interferon-α. Fours hours post addition of IFNα, RNA was collected and the transcriptional induction of several downstream ISGs (IFIT1, IFIT2, IFIT3, OAS1, OAS2 and MX1) were monitored by RT-qPCR as a read out for sensitivity to IFNα. Both telomerase-positive and ALT cells were found to be equally capable of transcriptionally inducing ISGs in response to treatment with IFNα (FIGS. 3A and 6A).

Figure 3B:
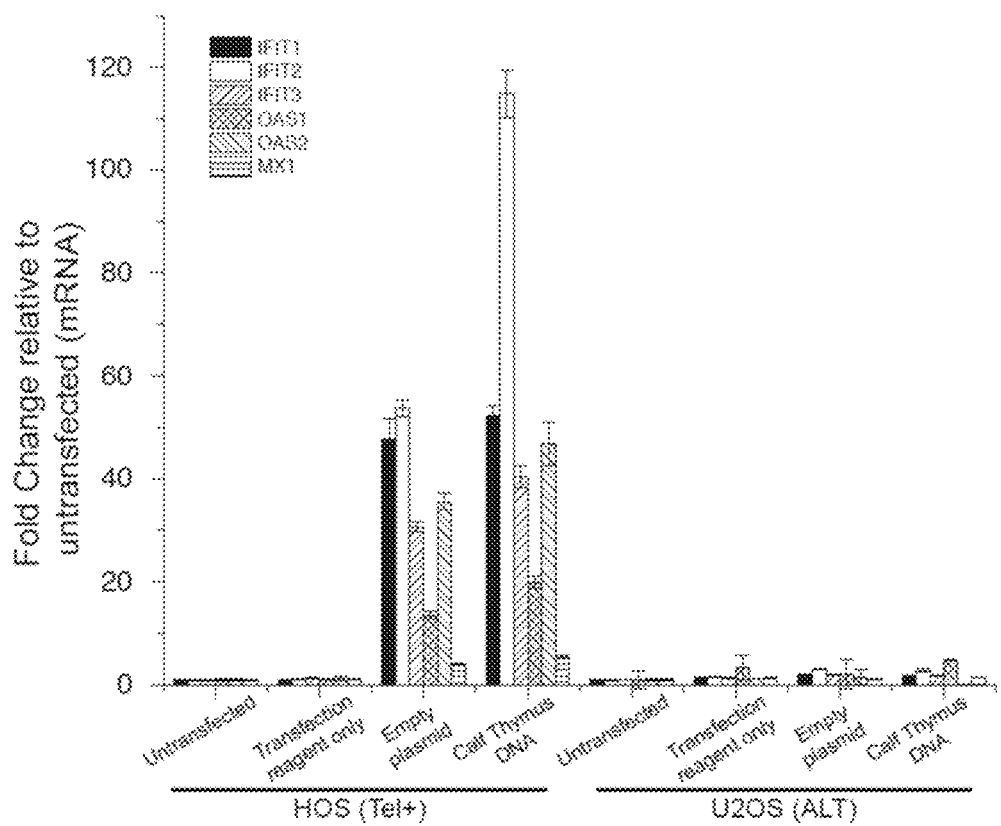
Figure 6B:
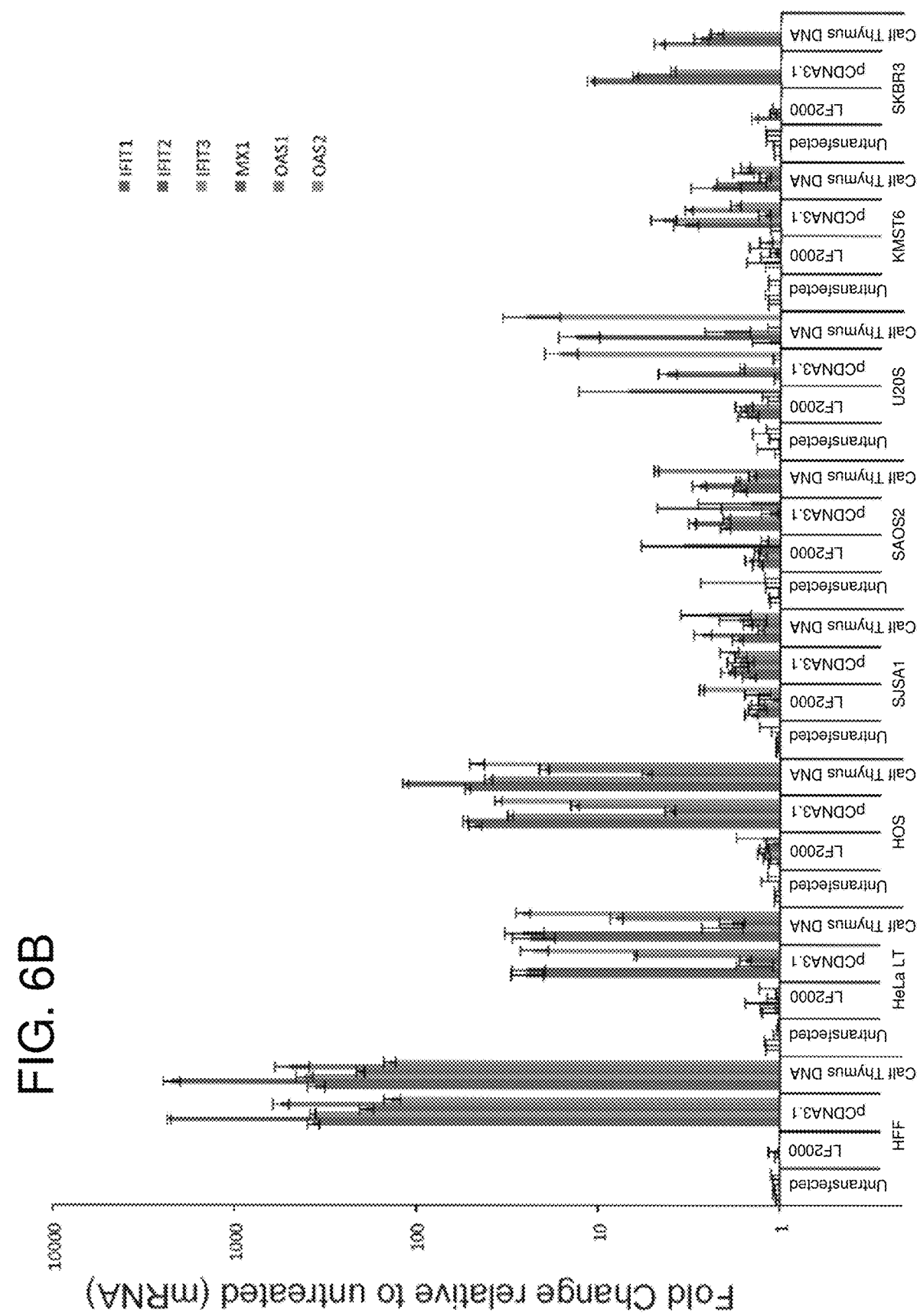

However, frequently a cell must recognize and respond to invading pathogens from within. This occurs through the detection a pathogens proteins and/or nucleic acids (Schneider et al., Annu Rev Immunol 32, 513-545, 2014; Ivashkiv and Donlin, Nat Rev Immunol 14, 36-49, 2014). Once detected, the cell must mount an appropriate response to contain and limit spread of the pathogen. This typically occurs through the activation of ISGs capable of limiting viral replication and alerting surrounding cells to the potential threat. It was hypothesized that the ECTRs generated during ALT may be mistaken as pathogenic DNA activating a cellular anti-viral response. Prolonged activation of such a response would be deleterious to the cell and would have to be dampened for the cell to fully transition to ALT. Although the response to IFNs in cells dependent on ALT was found to be still intact, it was reasoned that its ability to respond to an internally detected threat might be compromised. To test this, an empty pCDNA3.1 plasmid was introduced into the cell via transfection in order mimic DNA from an invading pathogen, such as HSV-1. RNA was harvested from the cells six hours post-transfection and subjected to RT-qPCR analysis for downstream ISGs as described above. Those cells that use ALT to maintain telomere length exhibited a severely dampened response to plasmid DNA (FIGS. 3B and 6B). However, cells that use telomerase largely induce the expression of downstream ISGs as would be expected (FIGS. 3B and 6B). It was questioned whether this response was specific to circular plasmid DNA or if other forms of extrachromosomal DNA could initiate a similar response. To test this, purified and sheared calf thymus DNA was transfected and activation of ISG effectors was assayed (FIG. 3B). The results demonstrated that the lack of response to foreign extrachromosomal DNA in ALT cells was a general phenomenon regardless of form or source.

Figure 3C:
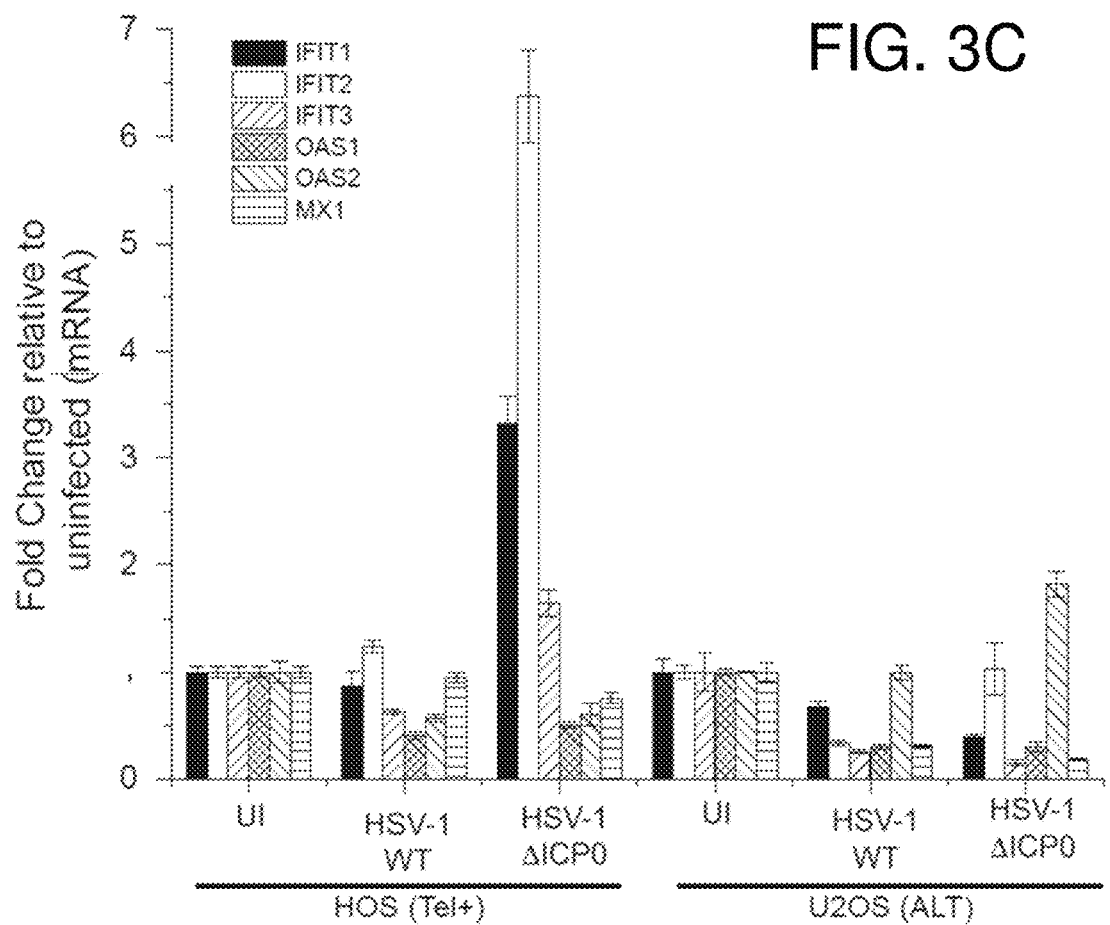

Next, studies were performed to determine whether infection with HSV-1 would recapitulate the differential response of telomerase-positive and ALT-dependent cells when challenged with foreign DNA. Both HOS (tel+) and U2OS (ALT) were infected with either HSV-1 WT or HSV-1 ΔICP0 at an MOI of 1 and incubated for 4 hours. Following treatment with the virus, RNA was harvested from the infected and uninfected cells and subjected to RT-qPCR as described above. HOS cells infected with HSV-1 ΔICP0 exhibited activation of many of the ISG assayed, while U2OS cells infected with HSV-1 ΔICP0 failed to induce transcription of the same ISGs (FIG. 3C). As expected, infection with HSV-1 WT led to the suppression of ISGs transcription in both HOS and U2OS. It was also observed that the induction of the ISGs assayed in response to HSV-1 ΔICP0 infection was not as robust as with IFNα treatment or transfection of DNA. This is likely due to the redundant anti-viral activity of other immediate early HSV-1 genes that are still expressed by HSV-1 ΔICP0, albeit to a lesser extent. Importantly, since HSV-1 deposits the viral genome directly into the nucleus this suggests that the response that is initiated is a result of the detection of the viral DNA in the nucleus and not in the cytoplasm where most DNA sensors have been proposed to function.

Figure 3D:
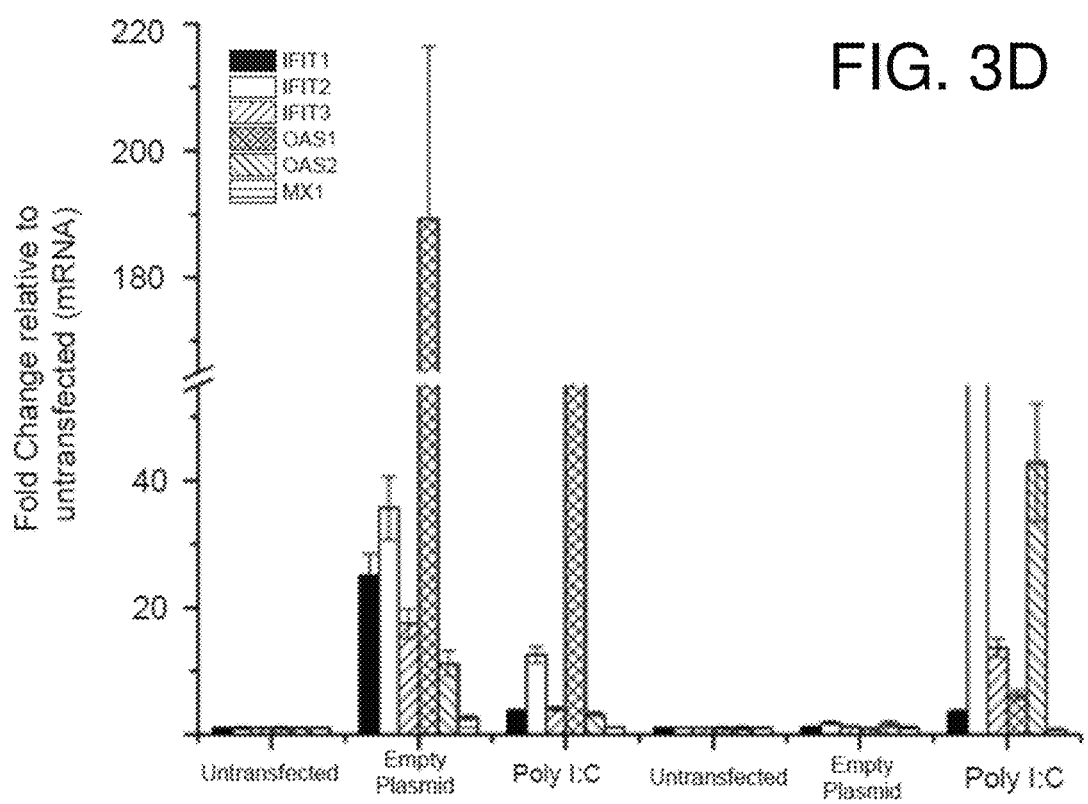

Since many of these ISGs can also be upregulated in response to double-stranded RNA via the toll-like receptor 3 (TLR3), it was examined whether this defect in ALT cells is specific to DNA or extends to foreign RNA as well. To test this, HOS (Tel+) and U2OS (ALT) cells were transfected with the dsRNA mimic PolyI:C. Four hours post-transfection, RNA was harvested from these cells and subjected to RT-qPCR as before. Although ALT cells failed to respond to extrachromosomal DNA, their ability to mount an appropriate transcriptional response to dsRNA was still intact (FIG. 3D).

Taken together, these data indicate that cells that use ALT as their preferred TMM have lost the ability to initiate and propagate an appropriate anti-viral transcriptional response when challenged with extrachromosomal DNA from within. The RNA-seq and microarray analysis further demonstrated that while this response overlaps with some of the same targets as the interferon response, it also has elements that overlap with inflammatory cytokine signaling, p53, cell cycle regulation, DNA damage response and telomerase signaling. Collectively, these elements come together to generate a potent extrachromosomal DNA induced anti-viral state in the cell. The inventors have termed this anti-viral response the 'Viral and Extrachromosomal DNA transcriptional response' or VECTR.

ALT, gC and ICP0 Functionally Converge

Figure 4A:
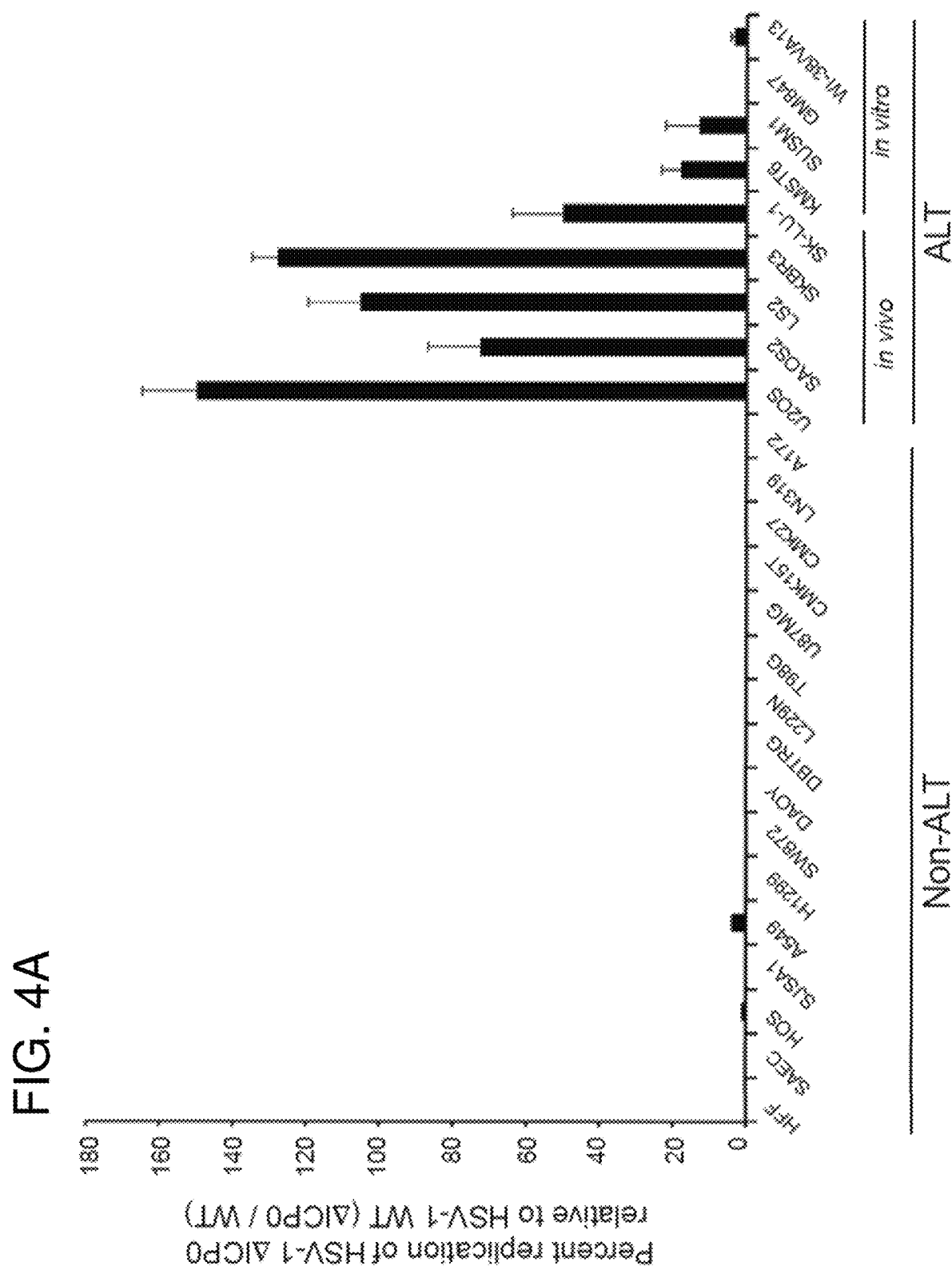
FIGS. 4A-4B.
Figure 9A:
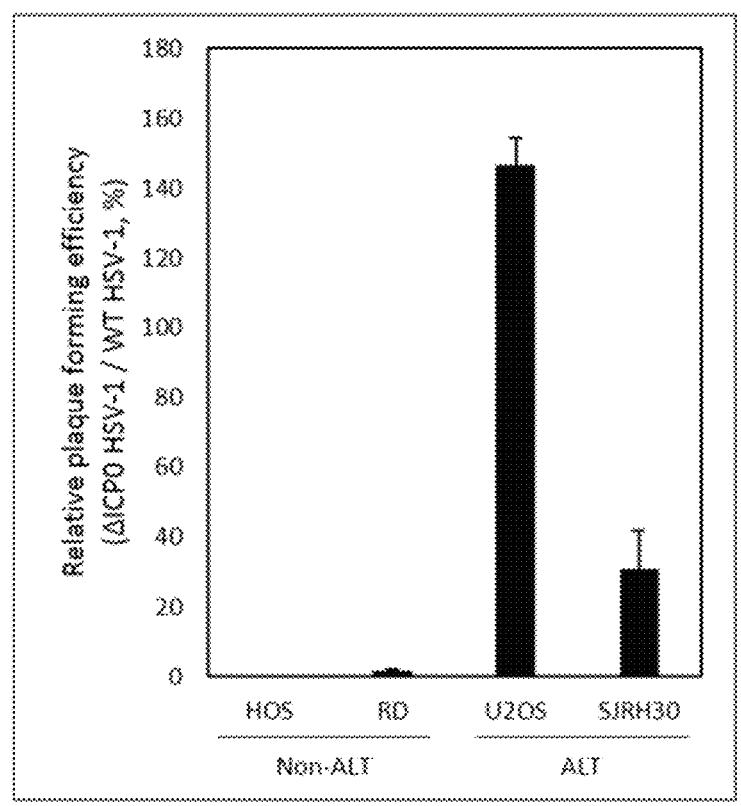
FIG. 9A-9B: Indicated cells were plated in 24 well plates and infected in duplicate with either HSV-1 WT or HSV-1 ΔICP0. At 36-48 hours post-infection, cells were stained with crystal violet and plaques were counted. The average number of plaques in ΔICP0 infected cells divided by the average number of plaques in WT infected cells was calculated to yield the relative plaque forming efficiency of HSV-1 ΔICP0 relative to HSV-1 WT in the indicated cell type, which was then normalized to 100%. Error bars represent standard deviation (SD).
Figure 9B:
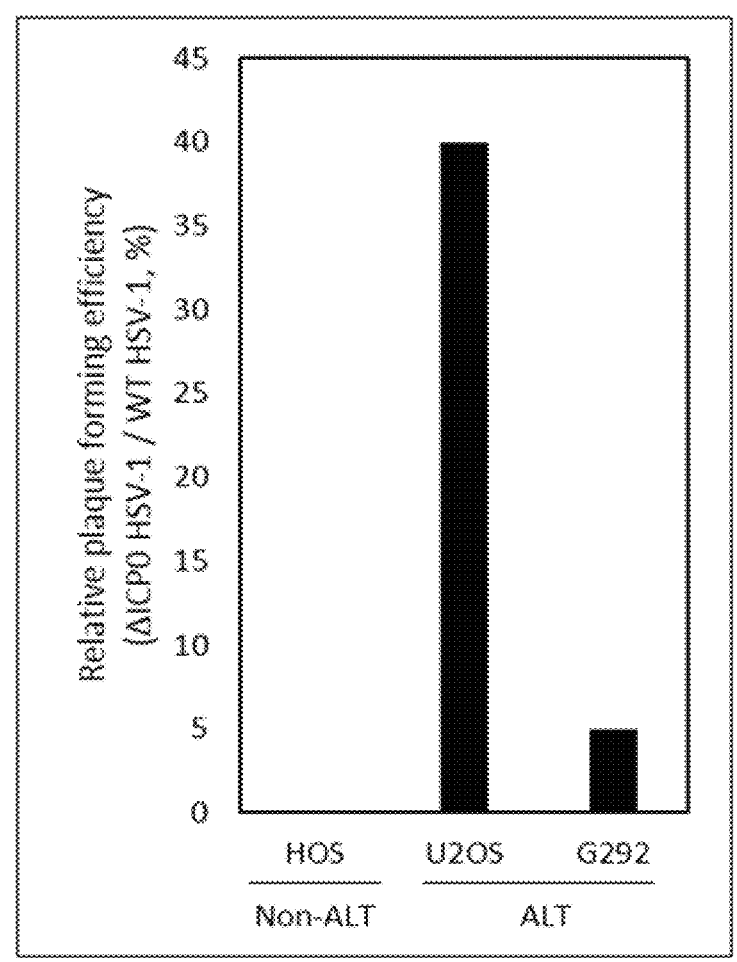

Loss of the protective anti-viral VECTR response is not only critical for the transition to ALT but indicates that ALT cells may be more susceptible to incoming pathogens than non-ALT cells. Since ICP0 and ALT seem to overlap in their functions, this may explain why U2OS cells rescue replication of an ICP0 null virus. Given these results, the prediction is that cells that use ALT to maintain telomere length should also rescue replication of an ICP0 deleted HSV-1 virus. This was tested by performing a plaque assay on 16 non-ALT and 11 ALT cell lines with both HSV-1 WT and an ICP0 deleted virus. Relative plaque forming efficiency of HSV-1 ΔICP0 virus was calculated by comparing the number of plaques formed at a particular MOI (~30 plaques/well) to the number of plaques formed in WT virus at that same MOI. No non-ALT cell lines rescued replication of HSV-1 ΔICP0, yet nearly all of the ALT cell lines rescued replication to some degree (FIG. 4A, FIG. 9A, and FIG. 9B). Those cell lines that rescue to a lesser extent are all cell lines that were in vitro transformed. This suggests that there may be additional in vivo selection that occurs, which further renders ALT cells permissive to HSV-1 replication.

Furthermore, a widely used ICP0 loss mutant HSV-1 (strain name dl1403) was found to have an unexpected mutation in its glycoprotein C gene, which is a deletion of 186th cytosine in its coding sequence (see FIG. 10). As a result, glycoprotein C peptide in dICP0 virus has extensive sequence change as well as premature termination at 175th codon.

SEQ ID NO: 17 shows the nucleotide sequence of WT HSV-1 gC from nucleotides 181-200:

(SEQ ID NO: 17)
ACCCCCACATCGACCCCAAA.

SEQ ID NO: 17 shows the mutant gC sequence from HSV-1 strain dl1403, from nucleotides 181-199:

(SEQ ID NO: 18)
ACCCCACATCGACCCCAAA.

SEQ ID NO: 19 shows the amino acid sequence of WT HSV-1 gC from amino acid 60-70:

(SEQ ID NO: 19)
VTPTSTPNPNN.

SEQ ID NO: 20 shows the amino acid sequence of HSV-1 strain dl1403 gC from amino acid 60-70:

(SEQ ID NO: 20)
VTPHRPQTPTM.

SEQ ID NO: 21 shows the amino acid sequence of WT HSV-1 gC from amino acid 171-180:

(SEQ ID NO: 21)
PAPDLEEVLT.

SEQ ID NO: 22 shows the amino acid of HSV-1 strain dl1403 gC from amino acid 171-174:

RLPT. (SEQ ID NO: 22)

This loss-of-function mutation of gC (glycoprotein C) in dICP0 HSV-1 is believed to inhibit its invasion efficiency into the cell because gC is a major cell membrane receptor binding protein, compared to its homologous proteins, gA and gB. Since their binding target molecule heparin sulfate is highly expressed in the fibroblast lineage, dICP0 HSV-1 infection ability can be underestimated when infected into such cells. At least in four osteosarcoma cell lines (HOS [TEL+], SJSA1[TEL+], SAOS2[ALT], U2OS[ALT]), the two TEL+ cell lines appear to have more fibroblast-like features, hence, presumably more heparan sulfate on their cell membrane, while ALT cell lines appear to be more epithelial. Thus, recombinant HSV-1 with modified gC, or gC deficient, may have higher selectivity for ALT-dependent tumor cells relative to the surrounding normal fibroblast tissue.

Discussion

Previous studies have shown that the loss of p53 and inactivating mutations in ATRX, a component of the PML NB, strongly correlates with ALT (Lovejoy et al., PLoS Genet 8, e1002772, 2012). However, inactivation of either has yet to recapitulate the phenotypes associated with ALT, indicating that additional changes are required for the full transition to ALT. The studies described herein demonstrated that the ECTR DNA that associates with PML NBs plays a critical role in the transition to ALT, thus defining another set of cellular changes required for telomere maintenance via ALT. From these data a model begins to take shape in which the transition to ALT is a multi-step and multi-genic process where any one mutation may not be sufficient.

It has been proposed that PML NBs facilitate telomere maintenance in ALT as well as sequester ECTRs away from the rest of the cell. This sequestration of ECTRs by PML NBs is thought to prevent the activation of a deleterious DNA damage response. However, it is proposed herein that the association of ECTRs and PML NBs is part of the normal cellular intrinsic immune response. As such, recognition of ECTRs as a potential pathogen leads to the activation and establishment of an anti-viral state in the cell. This may occur through both PML-dependent and PML-independent mechanisms. Continued activation of this response would prevent cellular replication. Therefore, suppression of this anti-viral response would have to occur if the cell were to switch to ALT and complete its malignant transformation (FIG. 4B).

Figure 4B:
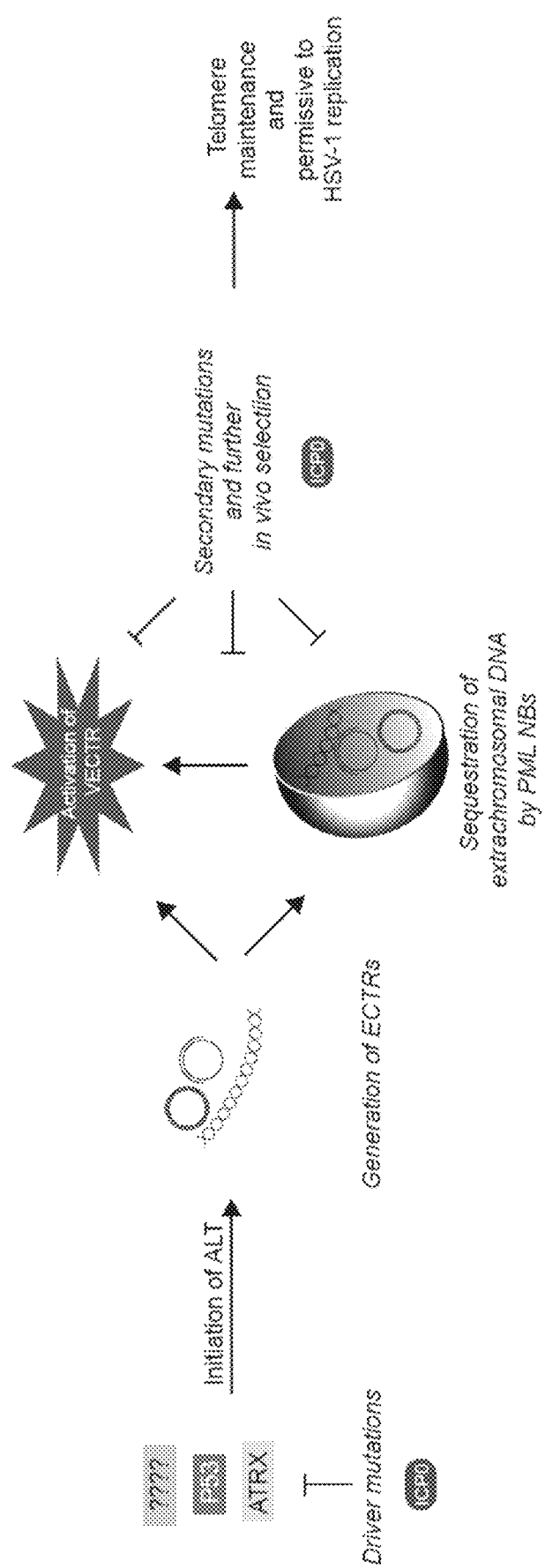

The studies described herein determined that inhibition of this DNA-specific anti-viral response, termed the VECTR response, phenocopies the activity of the HSV-1 protein ICP0 (FIG. 4B). As a result, ALT cells fail to recognize or respond appropriately to incoming HSV-1 genomes. The result is rescue of lytic replication of an ICP0 deleted HSV-1 virus in ALT dependent tumors. However, it is interesting that the tumor derived ALT cell line rescue of HSV-1 ΔICP0 lytic replication is more pronounced than the in vitro transformed ALT cell lines. This suggests in vivo selective pressures, which are missing when in vitro transformed cells transition to ALT, may further facilitate the transition to ALT.

Example 3: ALT-Dependent Tumor Xenograft Models

Figure 7A:
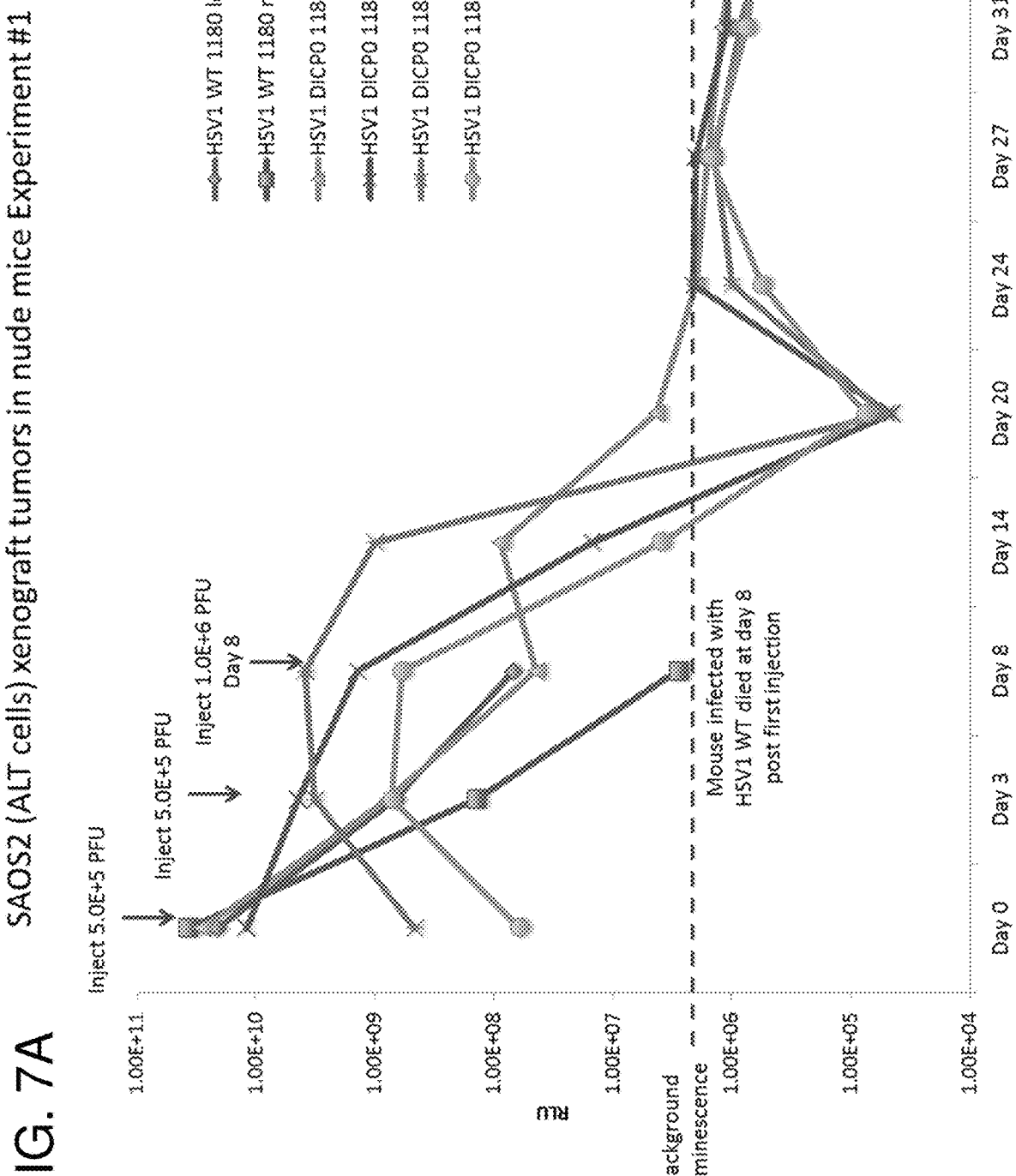
Figure 7B:
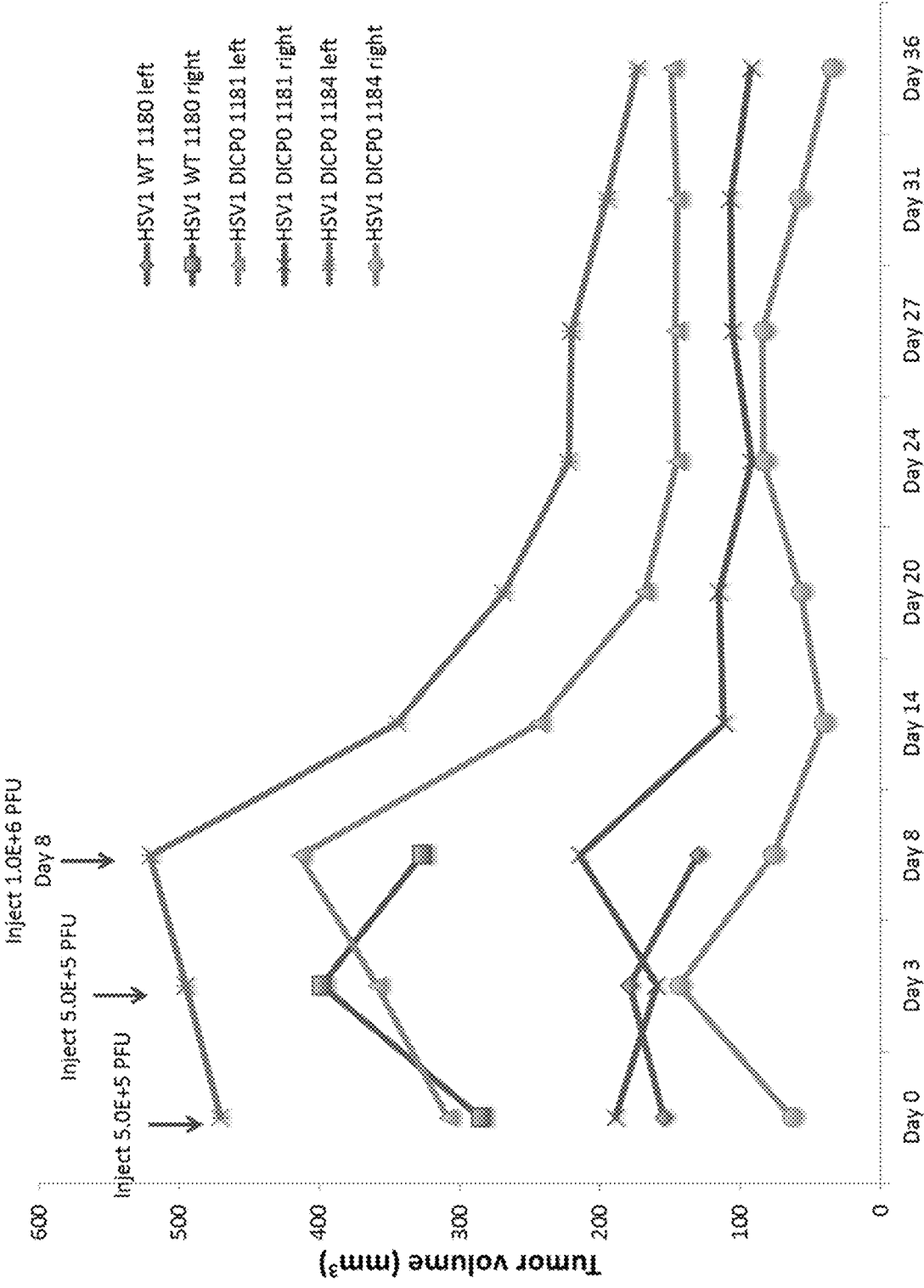

To assess oncolytic activity of HSV-1 ΔICP0 in vivo, the ALT-dependent osteosarcoma tumor cells SAOS2, which had been stably transduced with a lentiviral vector expressing a CMV driven luciferase reporter gene, were injected into the flanks of nude mice. Growth of the xenograft tumors was monitored by both luciferase activity and by tumor volume. Mice with established tumors were injected with either wild-type HSV-1 or HSV-1 ΔICP0 at Day 0 ($5\times10^5$ PFU), Day 3 ($5\times10^5$ PFU) and Day 8 ($1\times10^6$ PFU). Tumor cell viability, as measured by luciferase activity (FIG. 7A), and tumor cell volume (FIG. 7B) were measured at Days 0, 3, 8, 14, 20, 24, 27, 31 and 36. The results demonstrated that administration of either WT HSV-1 or HSV-1 ΔICP0 reduced tumor volume and eliminated tumor cell viability as demonstrated by the reduction of luciferase activity in the tumors down to background levels. In addition, it was found that HSV-1 ΔICP0 had no adverse effect on the overall health of the mouse, whereas administration of HSV-1 WT led to the death of the mouse after 8 days.

A second experiment was conducted in SAOS2 xenograft mice. Mice with established tumors were administered either DMEM (as a control), WT HSV-1 or HSV-1 ΔICP0 at Day 0 ($5\times10^5$ PFU), Day 4 ($5\times10^5$ PFU) and Day 8 ($1\times10^6$ PFU). Tumor cell viability (FIG. 7C) and tumor volume (FIG. 7D) were measured at Days 0, 4, 8, 12 and 17. The results demonstrated that administration of either WT HSV-1 or HSV-1 ΔICP0 reduced tumor cell viability and tumor volume.

Next, A549 cells, which are Tel+ adenocarcinoma tumor cells, were used to establish tumor xenografts in nude mice. Since A549 cells are not ALT-dependent, HSV-1 ΔICP0 is replication defective in these cells. Mice with established tumors were injected with either DMEM (as a control), WT HSV-1 or HSV-1 ΔICP0 at Day 0 ($5\times10^5$ PFU), Day 3 ($5\times10^5$ PFU) and Day 7 ($1\times10^6$ PFU). Tumor cell viability was measured at Days 0, 3, 7, 12 and 16. The results demonstrated that neither WT HSV-1 nor HSV-1 ΔICP0 were able to significantly decrease tumor viability.

Example 4: Additional Recombinant ICP0-Deficient Viruses

HSV-1 ICP0 null virus can be modified to include additional gene disruptions, such as disruptions in one or more of the ICP47 gene, the ICP34.5 gene and the ICP6 gene. Recombinant HSV-1 can also be further modified to encode heterologous proteins, such as an immunostimulatory molecule.

Figure 8:
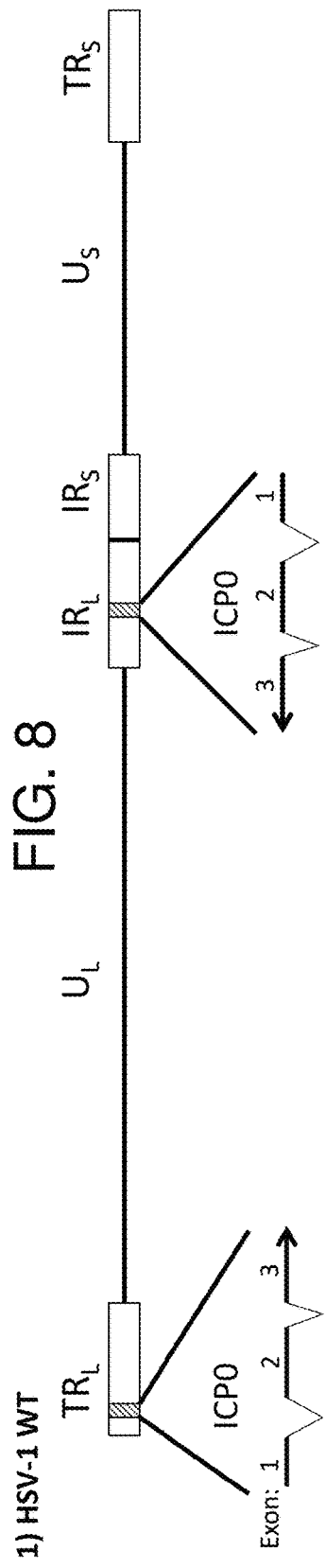
FIG. 8: Schematic diagrams of HSV-1 WT, HSV-1 ΔICP0 GM-CSF and HSV-1 ΔICP0/ΔICP47 GM-CSF.
Figure 8:
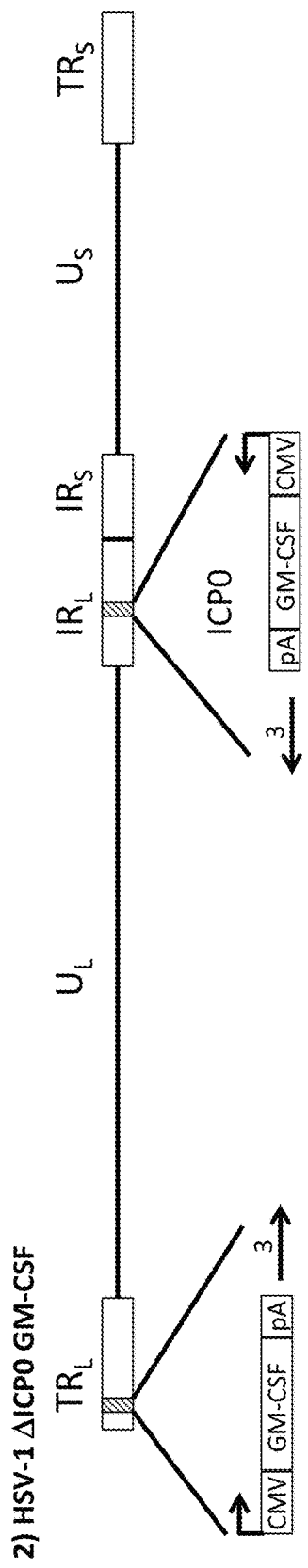
Figure 8:
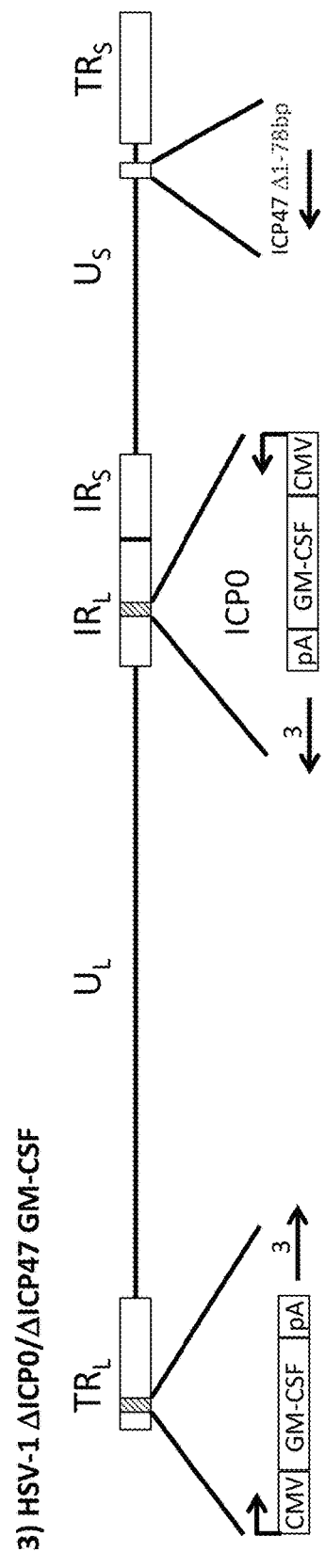

In one example, HSV-1 ΔICP0 is modified to insert a nucleic acid construct that includes the GM-CSF coding region into both $TR_L$ and $IR_L$. The GM-CSF coding sequence is operably linked to a CMV promoter and a polyA sequence (FIG. 8, construct 2). The genome sequence of this virus is set forth herein as SEQ ID NO: 15.

In another example, HSV-1 ΔICP0 is modified as indicated above to insert GM-CSF into both $TR_L$ and $IR_L$. The virus is further modified by partial deletion of the ICP47 gene (A1-78 bp) (FIG. 8, construct 3). The partial deletion of ICP47 removes the first 78 bp (encoding 26 amino acids) starting from the ATG start codon. It also removes the rest of the ATG sites downstream that could potentially be used as a start site. The genome sequence of this virus is set forth herein as SEQ ID NO: 16.

In one example, HSV-1 ΔICP0 is modified to insert a nucleic acid construct that includes the GM-CSF coding region into both $TR_L$ and $IR_L$. The GM-CSF coding sequence is operably linked to a CMV promoter and a polyA sequence (FIG. 8, construct 2). The virus is further modified by a point mutation of the gC gene (A168c) (FIG. 10) which results in non-expressing Gc. The genome sequence of this virus is set forth herein as SEQ ID NO: 23.

In another example, HSV-1 ΔICP0 is modified as indicated above to insert GM-CSF into both $TR_L$ and $IR_L$. The virus is further modified by a point mutation of the gC gene (A168c) (FIG. 10) which results in non-expressing Gc. The virus is further modified by partial deletion of the ICP47 gene (A1-78 bp) (FIG. 8, construct 3). The partial deletion of ICP47 removes the first 78 bp (encoding 26 amino acids) starting from the ATG start codon. It also removes the rest of the ATG sites downstream that could potentially be used as a start site. The genome sequence of this virus is set forth herein as SEQ ID NO: 24.

In view of the many possible embodiments to which the principles of the disclosure may be applied, it should be recognized that the illustrated embodiments are only examples of the disclosure and should not be taken as limiting the scope of the disclosure. Rather, the scope of the disclosure is defined by the following claims. We therefore claim all that comes within the scope and spirit of these claims.

SEQUENCE LISTING (27 sequences)

SEQ ID NO: 1 - DNA, 21 bp, Artificial Sequence
  Synthetic oligonucleotide
tgtccaaggtggtaaagggtg

SEQ ID NO: 2 - DNA, 20 bp, Artificial Sequence
  Synthetic oligonucleotide
caggtcaccagactcctcac

SEQ ID NO: 3 - DNA, 21 bp, Artificial Sequence
  Synthetic oligonucleotide
aagcacctcaaagggcaaaac

SEQ ID NO: 4 - DNA, 21 bp, Artificial Sequence
  Synthetic oligonucleotide
tcggcccatgtgatagtagac

SEQ ID NO: 5 - DNA, 22 bp, Artificial Sequence
  Synthetic oligonucleotide
tcagaagtctagtcacttgggg

SEQ ID NO: 6 - DNA, 21 bp, Artificial Sequence
  Synthetic oligonucleotide
acaccttcgccctttcatttc

SEQ ID NO: 7 - DNA, 21 bp, Artificial Sequence
  Synthetic oligonucleotide
tgtccaaggtggtaaagggtg

SEQ ID NO: 8 - DNA, 21 bp, Artificial Sequence
  Synthetic oligonucleotide
ccggcgatttaactgatcctg

SEQ ID NO: 9 - DNA, 19 bp, Artificial Sequence
  Synthetic oligonucleotide
aggtggctcctatggacgg

SEQ ID NO: 10 - DNA, 22 bp, Artificial Sequence
  Synthetic oligonucleotide
tttatcgaggatgtcacgttgg

SEQ ID NO: 11 - DNA, 20 bp, Artificial Sequence
  Synthetic oligonucleotide
cagcacctgatggcctatca

SEQ ID NO: 12 - DNA, 22 bp, Artificial Sequence
  Synthetic oligonucleotide
acgtctggagcatgaagaactg

SEQ ID NO: 13 - DNA, 24 bp, Artificial Sequence
  Synthetic oligonucleotide
ttcgacagtcagccgcatcttctt

SEQ ID NO: 14 - DNA, 23 bp, Artificial Sequence
  Synthetic oligonucleotide
caggcgcccaatacgaccaaatc

SEQ ID NO: 15 - DNA, 151382 bp, Artificial Sequence
  Recombinant HSV-1 vector
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagaccccgaaaacgggccccccccaaaacacaccccccgggggtcgcgcgcggccctttaaagcggcggcggcgggcagcccgggccccccgcggccgagactagcgagttagacaggcaagcactactcgcctctgcacgcacatgcttgcctgtcaaactctaccaccccggcacgctctctgtctccatggcccgccgccgccgccatcgcggcccccgccgcccccggccgcccgggcccacgggcgccgtcccaaccgcacagtcccaggtaacctccacgcccaactcggaacccgcggtcaggagcgcgcccgcggccgccccgccgccgccccccgccggtgggcccccgccttcttgttcgctgctgctgcgccagtggctccacgttcccgagtccgcgtccgacgacgacgatgacgacgactggccggacagccccccgcccgagccggcgccagaggcccggcccaccgccgccgccccccggccccggcccccaccgcccggcgtgggcccggggggcggggctgacccctcccaccccccctcgcgccccttccgccttccgccgcgcctcgccctccgcctgcgcgtcaccgcggagcacctggcgcgcctgcgcctgcgacgcgcgggcggggagggggcgccggagccccccgcgacccccgcgacccccgcgacccccgcgacccccgcgacccccgcgcgggtgcgcttctcgccccacgtccgggtgcgccacctggtggtctgggcctcggccgcccgcctggcgcgccgcggctcgtgggcccgcgagcgggccgaccgggctcggttccggcgccgggtggcggaggccgaggcggtcatcgggccgtgcctggggcccgaggcccgtgcccgggccctggcccgcggagccggcccggcgaactcggtctaacgttacacccgaggcggcctgggtcttccgcggagctcccgggagctccgcaccaagccgctctccggagagacgatggcaggagccgcgcatatatacgcttggagccagcccgccctcacagggcgggcccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgaaataaagcaatagcatcacaaatttcacaaataaagcattattttgtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgccggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccctcaccaccattcctactaccaccaccaccaccaccaccgacacctcccgcgcacccccgcccacatccccccccaacccgcaccaccagcacgggttgggggtagcaggggatcaaaggggggcaaagccggcggggcggttcggggggggggggggggggcgggagaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcgggcgctcctcgccgccctagaggctgtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgcttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccacccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgtgcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgcacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggaggccgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcgtccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacaggtgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgacgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagacgagggccgacccgggccgtggccgagatcgtactggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcccgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacgtgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgctgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccgcctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaagaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgggccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttttgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacgccgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgggcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaaattctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgcgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccgcgggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgcccgcaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggttcgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtcggcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcatgcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctatcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgatagcaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacgggccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgccggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgctgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcgctgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttgcgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcagtgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccggcatgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggctctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgagcccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacggccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtctcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccggcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcacaaaataatgctttatttgtgaaatttgtgatgctattgctttatttcactcctggactggctcccagcagtcaaaggggatgacaagcagaaagtccttcaggttctctttgaaactttcaaaggtgataatctgggttgcacaggaagtttccggggttggagggcagtgctgcttgtagtggctggccatcatggtcaaggggcccttgagcttggtgaggctgccccgcaggccctgcttgtacagctccaggcgggtctgtaggcaggtcggctcctggaggtcaaacatttctgagatgacttctactgtttcattcatctcagcagcagtgtctctactcaggttcaggagacgccgggcctcctggatggcattcacatgctcccagggctgcgtgctggggctgggcgagcgggcgggtgcagagatgctgcaggccacagtgcccaagagcagcaggctctgcagccacatcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcgggcccgccctgtgagggcgggctggctccaagcgtatatatgcgcggctcctgccatcgtctctccggagagcggcttggtgcggagctcccgggagctccgcggaagacccaggccgcctcgggtgtaacgttagaccgagttcgccgggccggctccgcgggccagggcccgggcacgggcctcgggccccaggcacggcccgatgaccgcctcggcctccgccacccggcgccggaaccgagcccggtcggcccgctcgcgggcccacgagccgcggcgcgccaggcgggcggccgaggcccagaccaccaggtggcgcacccggacgtggggcgagaagcgcacccgcgcgggggtcgcgggggtcgcgggggtcgcgggggtcgcgggggtcgcggggggctccggcgccccctccccgcccgcgcgtcgcaggcgcaggcgcgccaggtgctccgcggtgacgcgcaggcggagggcgaggcgcggcggaaggcggaaggggcgcgagggggggtgggaggggtcagccccgccccccgggcccacgccgggcggtgggggccggggccggggggcggcggcggtgggccgggcctctggcgccggctcgggcggggggctgtccggccagtcgtcgtcatcgtcgtcgtcggacgcggactcgggaacgtggagccactggcgcagcagcagcgaacaagaaggcgggggcccaccggcggggggcggcggcggggcggccgcgggcgcgctcctgaccgcgggttccgagttgggcgtggaggttacctgggactgtgcggttgggacggcgcccgtgggcccgggcggccgggggcggcgggggccgcgatggcggcggcggcgggccatggagacagagagcgtgccggggtggtagagtttgacaggcaagcatgtgcgtgcagaggcgagtagtgcttgcctgtctaactcgctagtctcggccgcggggggcccgggctgcccgccgccgccgctttaaagggccgcgcgcgacccccggggggtgtgttttggggggggcccgttttcggggtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgcccctccccagccccagccctccccggccccagccctccccggccccagccctccccggccccagccctccccggccccagccctccccggccccagccctccccggccccagccctccccggccccagccctccccggccgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcgcggtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccagttgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacagcgccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggccgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcgaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcggcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcgggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacatgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcggcctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggcgctgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaactggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcaccgcgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcggccggggagggctggggccggggagggctggggccggggagggctggggccggggagggctggggccggggagggctggggccggggagggctggggccggggagggctggggccggggagggctggggctggggaggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagaccccgaaaacgggccccccccaaaacacaccccccgggggtcgcgcgcggccctttaaagcggcggcggcgggc

SEQ ID NO: 16 - DNA, 151304 bp, Artificial Sequence
  Recombinant HSV-1 vector
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagaccccgaaaacgggccccccccaaaacacaccccccgggggtcgcgcgcggccctttaaagcggcggcggcgggcagcccgggccccccgcggccgagactagcgagttagacaggcaagcactactcgcctctgcacgcacatgcttgcctgtcaaactctaccaccccggcacgctctctgtctccatggcccgccgccgccgccatcgcggcccccgccgcccccggccgcccgggcccacgggcgccgtcccaaccgcacagtcccaggtaacctccacgcccaactcggaacccgcggtcaggagcgcgcccgcggccgccccgccgccgccccccgccggtgggcccccgccttcttgttcgctgctgctgcgccagtggctccacgttcccgagtccgcgtccgacgacgacgatgacgacgactggccggacagccccccgcccgagccggcgccagaggcccggcccaccgccgccgccccccggccccggcccccaccgcccggcgtgggcccggggggcggggctgacccctcccaccccccctcgcgccccttccgccttccgccgcgcctcgccctccgcctgcgcgtcaccgcggagcacctggcgcgcctgcgcctgcgacgcgcgggcggggagggggcgccggagccccccgcgacccccgcgacccccgcgacccccgcgacccccgcgacccccgcgcgggtgcgcttctcgccccacgtccgggtgcgccacctggtggtctgggcctcggccgcccgcctggcgcgccgcggctcgtgggcccgcgagcgggccgaccgggctcggttccggcgccgggtggcggaggccgaggcggtcatcgggccgtgcctggggcccgaggcccgtgcccgggccctggcccgcggagccggcccggcgaactcggtctaacgttacacccgaggcggcctgggtcttccgcggagctcccgggagctccgcaccaagccgctctccggagagacgatggcaggagccgcgcatatatacgcttggagccagcccgccctcacagggcgggcccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgaaataaagcaatagcatcacaaatttcacaaataaagcattattttgtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgccggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccctcaccaccattcctactaccaccaccaccaccaccaccgacacctcccgcgcacccccgcccacatccccccccaacccgcaccaccagcacgggttgggggtagcaggggatcaaaggggggcaaagccggcggggcggttcggggggggggggggggggcgggagaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcgggcgctcctcgccgccctagaggctgtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgcttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccacccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgtgcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgcacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggaggccgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcgtccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacaggtgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgacgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagacgagggccgacccgggccgtggccgagatcgtactggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcccgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacgtgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgctgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccgcctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaagaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgggccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttttgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacgccgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgggcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaaattctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgcgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccgcgggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgcccgcaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggttcgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtcggcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcatgcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctatcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgatagcaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacgggccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgccggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgctgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcgctgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttgcgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcagtgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccggcatgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggctctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgagcccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacggccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtctcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccggcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcacaaaataatgctttatttgtgaaatttgtgatgctattgctttatttcactcctggactggctcccagcagtcaaaggggatgacaagcagaaagtccttcaggttctctttgaaactttcaaaggtgataatctgggttgcacaggaagtttccggggttggagggcagtgctgcttgtagtggctggccatcatggtcaaggggcccttgagcttggtgaggctgccccgcaggccctgcttgtacagctccaggcgggtctgtaggcaggtcggctcctggaggtcaaacatttctgagatgacttctactgtttcattcatctcagcagcagtgtctctactcaggttcaggagacgccgggcctcctggatggcattcacatgctcccagggctgcgtgctggggctgggcgagcgggcgggtgcagagatgctgcaggccacagtgcccaagagcagcaggctctgcagccacatcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcgggcccgccctgtgagggcgggctggctccaagcgtatatatgcgcggctcctgccatcgtctctccggagagcggcttggtgcggagctcccgggagctccgcggaagacccaggccgcctcgggtgtaacgttagaccgagttcgccgggccggctccgcgggccagggcccgggcacgggcctcgggccccaggcacggcccgatgaccgcctcggcctccgccacccggcgccggaaccgagcccggtcggcccgctcgcgggcccacgagccgcggcgcgccaggcgggcggccgaggcccagaccaccaggtggcgcacccggacgtggggcgagaagcgcacccgcgcgggggtcgcgggggtcgcgggggtcgcgggggtcgcgggggtcgcggggggctccggcgccccctccccgcccgcgcgtcgcaggcgcaggcgcgccaggtgctccgcggtgacgcgcaggcggagggcgaggcgcggcggaaggcggaaggggcgcgagggggggtgggaggggtcagccccgccccccgggcccacgccgggcggtgggggccggggccggggggcggcggcggtgggccgggcctctggcgccggctcgggcggggggctgtccggccagtcgtcgtcatcgtcgtcgtcggacgcggactcgggaacgtggagccactggcgcagcagcagcgaacaagaaggcgggggcccaccggcggggggcggcggcggggcggccgcgggcgcgctcctgaccgcgggttccgagttgggcgtggaggttacctgggactgtgcggttgggacggcgcccgtgggcccgggcggccgggggcggcgggggccgcgatggcggcggcggcgggccatggagacagagagcgtgccggggtggtagagtttgacaggcaagcatgtgcgtgcagaggcgagtagtgcttgcctgtctaactcgctagtctcggccgcggggggcccgggctgcccgccgccgccgctttaaagggccgcgcgcgacccccggggggtgtgttttggggggggcccgttttcggggtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgcccctccccagccccagccctccccggccccagccctccccggccccagccctccccggccccagccctccccggccccagccctccccggccccagccctccccggccccagccctccccggccccagccctccccggccgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcgcggtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccagttgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacagcgccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggccgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcgaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcggcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcgggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcggcctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggcgctgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaactggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcaccgcgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcggccggggagggctggggccggggagggctggggccggggagggctggggccggggagggctggggccggggagggctggggccggggagggctggggccggggagggctggggccggggagggctggggctggggaggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagaccccgaaaacgggccccccccaaaacacaccccccgggggtcgcgcgcggccctttaaagcggcggcggcgggc

SEQ ID NO: 17 - DNA, 20 bp, Artificial Sequence
  Synthetic oligonucleotide
acccccacatcgaccccaaa

SEQ ID NO: 18 - DNA, 19 bp, Artificial Sequence
  Synthetic oligonucleotide
accccacatcgaccccaaa

SEQ ID NO: 19 - protein, 11 aa, Artificial Sequence
  Synthetic peptide
VTPTSTPNPNN

SEQ ID NO: 20 - protein, 11 aa, Artificial Sequence
  Synthetic peptide
VTPHRPQTPTM

SEQ ID NO: 21 - protein, 10 aa, Artificial Sequence
  Synthetic peptide
PAPDLEEVLT

SEQ ID NO: 22 - protein, 4 aa, Artificial Sequence
  Synthetic peptide
RLPT

SEQ ID NO: 23 - DNA, 151381 bp, Artificial Sequence
  Recombinant HSV-1
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagaccccgaaaacgggccccccccaaaacacaccccccgggggtcgcgcgcggccctttaaagcggcggcggcgggcagcccgggccccccgcggccgagactagcgagttagacaggcaagcactactcgcctctgcacgcacatgcttgcctgtcaaactctaccaccccggcacgctctctgtctccatggcccgccgccgccgccatcgcggcccccgccgcccccggccgcccgggcccacgggcgccgtcccaaccgcacagtcccaggtaacctccacgcccaactcggaacccgcggtcaggagcgcgcccgcggccgccccgccgccgccccccgccggtgggcccccgccttcttgttcgctgctgctgcgccagtggctccacgttcccgagtccgcgtccgacgacgacgatgacgacgactggccggacagccccccgcccgagccggcgccagaggcccggcccaccgccgccgccccccggccccggcccccaccgcccggcgtgggcccggggggcggggctgacccctcccaccccccctcgcgccccttccgccttccgccgcgcctcgccctccgcctgcgcgtcaccgcggagcacctggcgcgcctgcgcctgcgacgcgcgggcggggagggggcgccggagccccccgcgacccccgcgacccccgcgacccccgcgacccccgcgacccccgcgcgggtgcgcttctcgccccacgtccgggtgcgccacctggtggtctgggcctcggccgcccgcctggcgcgccgcggctcgtgggcccgcgagcgggccgaccgggctcggttccggcgccgggtggcggaggccgaggcggtcatcgggccgtgcctggggcccgaggcccgtgcccgggccctggcccgcggagccggcccggcgaactcggtctaacgttacacccgaggcggcctgggtcttccgcggagctcccgggagctccgcaccaagccgctctccggagagacgatggcaggagccgcgcatatatacgcttggagccagcccgccctcacagggcgggcccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgaaataaagcaatagcatcacaaatttcacaaataaagcattattttgtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgccggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccctcaccaccattcctactaccaccaccaccaccaccaccgacacctcccgcgcacccccgcccacatccccccccaacccgcaccaccagcacgggttgggggtagcaggggatcaaaggggggcaaagccggcggggcggttcggggggggggggggggggcgggagaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcgggcgctcctcgccgccctagaggctgtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgcttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccacccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgtgcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgcacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggaggccgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcgtccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacaggtgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgacgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagacgagggccgacccgggccgtggccgagatcgtactggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcccgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacgtgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgctgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccgcctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaagaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgggccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttttgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacgccgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgggcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaaattctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgcgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccgcgggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgcccgcaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggttcgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtcggcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcatgcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctatcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgatagcaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacgggccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgccggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgctgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcgctgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttgcgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcagtgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcaccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccggcatgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggctctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgagcccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacggccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtctcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccggcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcacaaaataatgctttatttgtgaaatttgtgatgctattgctttatttcactcctggactggctcccagcagtcaaaggggatgacaagcagaaagtccttcaggttctctttgaaactttcaaaggtgataatctgggttgcacaggaagtttccggggttggagggcagtgctgcttgtagtggctggccatcatggtcaaggggcccttgagcttggtgaggctgccccgcaggccctgcttgtacagctccaggcgggtctgtaggcaggtcggctcctggaggtcaaacatttctgagatgacttctactgtttcattcatctcagcagcagtgtctctactcaggttcaggagacgccgggcctcctggatggcattcacatgctcccagggctgcgtgctggggctgggcgagcgggcgggtgcagagatgctgcaggccacagtgcccaagagcagcaggctctgcagccacatcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcgggcccgccctgtgagggcgggctggctccaagcgtatatatgcgcggctcctgccatcgtctctccggagagcggcttggtgcggagctcccgggagctccgcggaagacccaggccgcctcgggtgtaacgttagaccgagttcgccgggccggctccgcgggccagggcccgggcacgggcctcgggccccaggcacggcccgatgaccgcctcggcctccgccacccggcgccggaaccgagcccggtcggcccgctcgcgggcccacgagccgcggcgcgccaggcgggcggccgaggcccagaccaccaggtggcgcacccggacgtggggcgagaagcgcacccgcgcgggggtcgcgggggtcgcgggggtcgcgggggtcgcgggggtcgcggggggctccggcgccccctccccgcccgcgcgtcgcaggcgcaggcgcgccaggtgctccgcggtgacgcgcaggcggagggcgaggcgcggcggaaggcggaaggggcgcgagggggggtgggaggggtcagccccgccccccgggcccacgccgggcggtgggggccggggccggggggcggcggcggtgggccgggcctctggcgccggctcgggcggggggctgtccggccagtcgtcgtcatcgtcgtcgtcggacgcggactcgggaacgtggagccactggcgcagcagcagcgaacaagaaggcgggggcccaccggcggggggcggcggcggggcggccgcgggcgcgctcctgaccgcgggttccgagttgggcgtggaggttacctgggactgtgcggttgggacggcgcccgtgggcccgggcggccgggggcggcgggggccgcgatggcggcggcggcgggccatggagacagagagcgtgccggggtggtagagtttgacaggcaagcatgtgcgtgcagaggcgagtagtgcttgcctgtctaactcgctagtctcggccgcggggggcccgggctgcccgccgccgccgctttaaagggccgcgcgcgacccccggggggtgtgttttggggggggcccgttttcggggtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgcccctccccagccccagccctccccggccccagccctccccggccccagccctccccggccccagccctccccggccccagccctccccggccccagccctccccggccccagccctccccggccccagccctccccggccgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcgcggtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccagttgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacagcgccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggccgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcgaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcggcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcgggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgcgtacgtcggcgtacgtcctgggcccaacccgcatggtgtccaggaaggtgtccgccatttccagggcccacgacatgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcggcctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggcgctgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaactggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcaccgcgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcggccggggagggctggggccggggagggctggggccggggagggctggggccggggagggctggggccggggagggctggggccggggagggctggggccggggagggctggggccggggagggctggggctggggaggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagaccccgaaaacgggccccccccaaaacacaccccccgggggtcgcgcgcggccctttaaagcggcggcggcgggc

SEQ ID NO: 24 - DNA, 151303 bp, Artificial Sequence
  Recombinant HSV-1
agcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagaccccgaaaacgggccccccccaaaacacaccccccgggggtcgcgcgcggccctttaaagcggcggcggcgggcagcccgggccccccgcggccgagactagcgagttagacaggcaagcactactcgcctctgcacgcacatgcttgcctgtcaaactctaccaccccggcacgctctctgtctccatggcccgccgccgccgccatcgcggcccccgccgcccccggccgcccgggcccacgggcgccgtcccaaccgcacagtcccaggtaacctccacgcccaactcggaacccgcggtcaggagcgcgcccgcggccgccccgccgccgccccccgccggtgggcccccgccttcttgttcgctgctgctgcgccagtggctccacgttcccgagtccgcgtccgacgacgacgatgacgacgactggccggacagccccccgcccgagccggcgccagaggcccggcccaccgccgccgccccccggccccggcccccaccgcccggcgtgggcccggggggcggggctgacccctcccaccccccctcgcgccccttccgccttccgccgcgcctcgccctccgcctgcgcgtcaccgcggagcacctggcgcgcctgcgcctgcgacgcgcgggcggggagggggcgccggagccccccgcgacccccgcgacccccgcgacccccgcgacccccgcgacccccgcgcgggtgcgcttctcgccccacgtccgggtgcgccacctggtggtctgggcctcggccgcccgcctggcgcgccgcggctcgtgggcccgcgagcgggccgaccgggctcggttccggcgccgggtggcggaggccgaggcggtcatcgggccgtgcctggggcccgaggcccgtgcccgggccctggcccgcggagccggcccggcgaactcggtctaacgttacacccgaggcggcctgggtcttccgcggagctcccgggagctccgcaccaagccgctctccggagagacgatggcaggagccgcgcatatatacgcttggagccagcccgccctcacagggcgggcccgcctcgggggcgggactggccaatcggcggccgccagcgcggcggggcccggccaaccagcgtccgccgagtcttcggggcccggcccattgggcgggagttaccgcccaatgggccgggccgcccacttcccggtatggtaattaaaaacttgcaagaggccttgttccgcttcccggtatggtaattagaaactcattaatgggcggccccggccgcccttcccgcttccggcaattcccgcggcccttaatgggcaaccccggtattccccgcctcccgcgccgcgcgtaaccactcccctggggttccgggttatgctaattgcttttttggcggaacacacggcccctcgcgcattggcccgcgggtcgctcaatgaacccgcattggtcccctggggttccgggtatggtaatgagtttcttcgggaaggcgggaagccccggggcaccgacgcaggccaagcccctgttgcgtcggcgggaggggcatgctaatggggttctttgggggacaccgggttgggcccccaaatcgggggccgggccgtgcatgctaatgatattctttgggggcgccgggttggtccccggggacggggccgccccgcggtgggcctgcctcccctgggacgcgcggccattgggggaatcgtcactgccgcccctttggggaggggaaaggcgtggggtataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgacccccagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgaaataaagcaatagcatcacaaatttcacaaataaagcattattttgtgaggcggggggcggcaaggaccctgggggaggaggaggaggagggggggggagggaggaataggcgggcgggcgaggaaagggcgggccggggagggggcgtaacctgatcgcgccccccgttgtctcttgcagcagactacgtaccgcccgccccccgccggacgccccgcgcccccccacgcagaggcgccgccgcgccccccgtgacgggcggggcgtctcacgcagccccccagccggccgcggctcggacagcgcccccctcggcgcccatcgggccacacggcagcagtaacaccaacaccaccaccaacagcagcggcggcggcggctcccgccagtcgcgagccgcggcgccgcggggggcgtctggcccctccgggggggttggggttggggttggggttgttgaagcggaggcggggcggccgaggggccggacgggcccccttgtcaacagacccgccccccttgcaaacaacagagaccccatagtgatcagcgactcccccccggcctctccccacaggccccccgcggcgcccatgccaggctccgccccccgccccgggccccccgcgtccgcggccgcgtcgggacccgcgcgcccccgcgcggccgtggccccgtgcgtgcgagcgccgcctccggggcccggcccccgcgccccggcccccggggcggagccggccgcccgccccgcggacgcgcgccgtgtgccccagtcgcactcgtccctggctcaggccgcgaaccaagaacagagtctgtgccgggcgcgtgcgacggtggcgcgcggctcgggggggccgggcgtggagggtgggcacgggccctcccgcggcgccgccccctccggcgccgccccgctcccctccgccgcctctgtcgagcaggaggcggcggtgcgtccgaggaagaggcgcgggtcgggccaggaaaacccctccccccagtccacgcgtccccccctcgcgccggcaggggccaagagggcggcgacgcaccccccctccgactcagggccgggggggcgcggccagggtgggcccgggacccccctgacgtcctcggcggcctccgcctcttcctcctctgcctcttcctcctcggccccgacccccgcgggggccgcctcttccgccgccggggccgcgtcctcctccgcttccgcctcctcgggcggggccgtcggtgccctgggagggagacaagaggaaacctccctcggcccccgcgctgcttctgggccgcgggggccgaggaagtgtgcccggaagacgcgccacgcggagacttccggggccgtccccgcgggcggcctcacgcgctacctgcccatctcgggggtctctagcgtggtcgccctgtcgccttacgtgaacaagactatcacgggggactgcctgcccatcctggacatggagacggggaacatcggggcgtacgtggtcctggtggaccagacgggaaacatggcgacccggctgcgggccgcggtccccggctggagccgccgcaccctgctccccgagaccgcgggtaaccacgtgatgccccccgagtacccgacggcccccgcgtcggagtggaacagcctctggatgacccccgtggggaacatgctgttcgaccagggcaccctagtgggcgccctggacttccgcagcctgcggtctcggcacccgtggtccggggagcagggggcgtcgacccgggacgagggaaaacaataagggacgccccccgtgtttgtggggaggggggggtcgggcgctgggtggtctctggccgcgcccactacaccagccaatccgtgtcggggaggggaaaagtgaaagacacgggcaccacacaccagcgggtcttttgtgttggccctaataaaaaaaaactcaggggatttttgctgtctgttgggaaataaaggtttacttttgtatcttttccctgtctgtgttggatgtatcgcggggatgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgcgtgggagtgggggtgccatgttgggcaggctctggtgttaaccacagagccgcggcccgggctgcctgaccaccgatccccgaaagcatcctgccactggcatggagccagaaccacagtgggttgggtgtgggtgttaagtttccgcgagcgcctgcccgcccggactgacctggcctctggccgccacaaagggcggggggggttaactacactatagggcaacaaaggatgggaggggtggcggggcgggacggggcgcccaaaagggggtcggccacaccacagacgtgggtgttggggggtggggcggaggggtgggggggggggagacagaaacaggaacatagttagaaaacaagaatgcggtgcagccagagaatcacaggagacgaggggatgggcgtgttggttaccaacccacacccaggcatgctcggtggtatgaaggagggggggcggtgcttcttagagaccgccgggggacgtggggttggtgtgcaaaggcacgcgcacccgcgccggccaggtgggccggtactccatccccccctcccccgacccttcccacccccgcgtgccagagatcaccccggtcccccggcacccgccactcctccgtatcctcgctttaggaacaactttagggggggtacacacgcgccgtgcatttccttccacaccccccctcccccgcactccccccccccaggcagtaagacccaagcatagagagccaggcacaaaaacacaggcggggtgggacacatgccttcttggagtacgtgggtcattggcgtggggggttacagcgacaccggccgaccccctggcggtcttccagccggcccttagataagggggcagttggtggtcggacgggtaagtaacagagtctgactaagggtgggagggggggaaaagaacgggctggtgtgctgtaacacgagcccacccgcgagtggcgtggccgaccttagcctctggggcgccccctgtcgtttgggtcccccccctctattggggagaagcaggtgtctaacctacctggaaacgcggcgtctttgttgaacgacaccggggcgccctcgacgagtgggataacgggggaggaagggagggaggagggtactgggggtgaagaaggggggggggagaagcgagaacaggaaaggcgatggagcccggcagaacaccgaggaaaaaaaaaccacagcgcatgcgccgggccgttgtggggccccgggccggggccccttgggtccgccggggccccgggccgggccgccacgggggccggccgttggcggtaaccccgagtgttcatctcaggccccgggccgggaacccggaaaagcctccggggggcctttttcgcgtcgcgtgccggcgagcgggtccggacggggcccggaccgccgcggtcgggggcccctcgtcccgggccgtacgcggccttcgccccgtgaggggacagacgaacgaaacattccggcgacggaacgaaaaacaccccagacgggttaaagaaacagaaaccgcaacccccaccacccccgaaacggggaaaacgaaaaaacagaccagcggccggccggcgcttagggggaggatgtcgccgacgccccttggccgccccggctgcaggggggcccggagagccgcggcacccggacgcgcccggaaagtctttcgcaccacccgcgatcggcacggccgcgcccccgcttttataaaggctgagatgacgcagcaaaaacaggccacagcaccacgtgggtaggtgatgtaattttattttcctcgtctgcggcctaatggatttccgggcgcggtgcccctgtctgcagagcacttaacggattgatatctcgcgggcacgcgcgcccttaatggaccggcgcggggcggggggccggatacccacacgggcggggggggggtgtcgcgggccgtctgctggcccgcggccacataaacaatgactctgggcctttctgcctctgccgcttgtgagtgcgcgcgccggctctgcggtgtcggcggcggctgcggcggctgcggcggccgccgtgttcggtctcggtagccggccggcgggtggactcgcggggggccggagggtggaaggcaggggggtgtaggatgggtatcaggacttccacttcccgtccttccatcccccgttcccctcggttgttcctcgcctcccccaacaccccgccgctttccgttggggttgttattgttgtcgggatcgtgcgggccgggggtcgccggggcaggggcgggggcgtgggcgggggtgctcgtcgatcgaccgggctcagtgggggcgtggggtgggtgggagaaggcgaggagactggggtgggggtgtcggtgggtggttgttttttgtggttgtttttgtgtctgttcccgtcccccgtcaccccctccctccgtcccctccgtccccccgtcgcgggtgtttgtgtttgtttattccgacattggtttatttaaataaacacagccgttctgcgtgtctgttcttgcgtgtggctgggggcttatatgtggggtcccgggggcgggatggggtttagcggcggggggcggcgcgccggacggggcgctggagataacggcccccggggaacgggggaccggggctgggtatcccgaggtgggtgggtgggcggcggtggccgggccgggccgggccgggccgggccgggtgggcggggtttggaaaaacgaggaggaggaggagaaggcgggggggggggagacggggggaaagcaaggacacggcccggggggtgggagcgcgggccgggccgctcgtaagagccgcgacccggccgccggggagcgttgtcgccgtcggtctgccggcccccgtccctcccttttttgaccaaccagcgccccccccccctcaccaccattcctactaccaccaccaccaccaccaccgacacctcccgcgcacccccgcccacatccccccccaacccgcaccaccagcacgggttgggggtagcaggggatcaaaggggggcaaagccggcggggcggttcggggggggggggggggggcgggagaccaagtaggcccgcccatccgcggcccctcccggcagccacgcccccagcgtcgggtgtcacggggaaagagcagaggggagaggggagagggggggagaggggagagggggggagaggggagagggggggagaggggagagggggggagaggggagagggggggagaggggagagggggggagaggggagagggggggagaggggagagggggggagaggggagagggggggagaggggagagggggggagagggggtatataaaccaacgaaaagcgcgggaacggggatacggggcttgtgtggcacgacgtcgtggttgtgttactgggcaaacacttggggactgtaggtttctgtgggtgccgaccctaggcgctatggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctctaacgatgcctcgacggaaacccgtccgggttcggggggcgaaccggccgcctgtcgctcgtcagggccggcgggcgctcctcgccgccctagaggctgtcccgctggtgtgacgttttcctcgtccgcgccccccgaccctcccatggatttaacaaacgggggggtgtcgcctgcggcgacctcggcgcctctggactggaccacgtttcggcgtgtgtttctgatcgacgacgcgtggcggcccctgatggagcctgagctggcgaaccccttaaccgcccacctcctggccgaatataatcgtcggtgccagaccgaagaggtgctgccgccgcgggaggatgtgttttcgtggactcgttattgcacccccgacgaggtgcgcgtggttatcatcggccaggacccatatcaccaccccggccaggcgcacggacttgcgtttagcgtgcgcgcgaacgtgccgcctcccccgagtcttcggaatgtcttggcggccgtcaagaactgttatcccgaggcacggatgagcggccacggttgcctggaaaagtgggcgcgggacggcgtcctgttactaaacacgaccctgaccgtcaagcgcggggcggcggcgtcccactctagaatcggttgggaccgcttcgtgggcggagttatccgccggttggccgcgcgccgccccggcctggtgtttatgctctggggcacacacgcccagaatgccatcaggccggaccctcgggtccattgcgtcctcaagttttcgcacccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttaatggttaaacctctggtctcatacgggtcggtgatgtcgggcgtcgggggagagggagttccctctgcgcttgcgattctagcctcgtggggctggacgttcgacacgccaaaccacgagtcggggatatcgccagatacgactcccgcagattccattcggggtgccgctgtggcctcacctgaccaacctttacacgggggcccggaacgggaggccacagcgccgtctttctccccaacgcgcgcggatgacggcccgccctgtaccgacgggccctacgtgacgtttgataccctgtttatggtgtcgtcgatcgacgaattagggcgtcgccagctcacggacaccatccgcaaggacctgcggttgtcgctggccaagtttagcattgcgtgcaccaagacctcctcgttttcgggaaacgccccgcgccaccacagacgcggggcgttccagcgcggcacgcgggcgccgcgcagcaacaaaagcctccagatgtttgtgttgtgcaaacgcgcccacgccgctcgagtgcgagagcagcttcgggtcgttattcagtcccgcaagccgcgcaagtattacacgcgatcttcggacgggcggctctgccccgccgtccccgtgttcgtccacgagttcgtctcgtccgagccaatgcgcctccaccgagataacgtcatgctggcctcgggggccgagtaaccgccccccccccatgccaccctcactgcccgtcgcgcgtgtttgatgttaataaataacacataaatttggctggttgtttgttgtctttaatggaccgcccgcaagggggggggggcatttcagtgtcgggtgacgagcgcgatccggccgggatcctaggaccccaaaagtttgtctgcgtattccagggcggggctcagttgaatctcccgcagcacctctaccagcaggtccgcggtgggctggagaaactcggccgtcccggggcaggcggttgtcgggggtggaggcgcggcgcccaccccgtgtgccgcgcctggcgtctcctctgggggcgacccgtaaatggttgcagtgatgtaaatggtgtccgcggtccagaccacggtcaaaatgccggccgtggcgctccgggcgctttcgccgcgcgaggagctgacccaggagtcgaacggatacgcgtacatatgggcgtcccacccgcgttcgagcttctggttgctgtcccggcctataaagcggtaggcacaaaattcggcgcgacagtcgataatcaccaacagcccaatgggggtgtgctggataacaacgcctccgcgcggcaggcggtcctggcgctcccggccccgtaccatgatcgcgcgggtgccgtactcaaaaacatgcaccacctgcgcggcgtcgggcagtgcgctggtcagcgaggccctggcgtggcataggctatacgcgatggtcgtctgtggattggacatctcgcggtgggtagtgagtcccccgggccgggttcggtggaactgtaaggggacggcgggttaatagacaatgaccacgttcggatcgcgcagagccgatagtatgtgctcactaatgacgtcatcgcgctcgtggcgctcccggagcggatttaagttcatgcgaaggaattcggaggaggtggtgcgggacatggccacgtacgcgctgttgaggcgcaggttgccgggcgtaaagcagatggcgaccttgtccaggctaaggccctgggagcgcgtgatggtcatggcaagcttggagctgatgccgtagtcggcgtttatggccatggccagctccgtagagtcaatggactcgacaaactcgctgatgttggtgttgacgacggacatgaagccgtgttggtcccgcaagaccacgtaaggcaggggggcctcttccagtaactcggccacgttggccgtcgcgtgccgcctccgcagctcgtccgcaaaggcaaacacccgtgcgtacgtgtatcccatgagcgtataattgtccgtctgcagggcgacggacatcagccccccgcgcggcgagccggtcagcatctcgcagccccggaagataacgttgtccacgtacgtgctaaagggggcgacttcaaatgcctccccgaagagctcttggaggattcggaatctcccgaggaaggcccgcttcagcagcgcaaactgggtgtgaacggcggcggtggtctccggttccccgggggtgtagtggcagtaaaacacgtcgagctgttgttcgtccagccccgcgaaaataacgtcgaggtcgtcgtcgggaaaatcgtccgggcccccgtcccgcggccccagttgcttaaaatcaaacgcacgctcgccgggggcgcctgcgtcggccattaccgacgcctgcgtcggcacccccgaagatttggggcgcagagacagaatctccgccgttagttctcccatgcgggcgtaggcgagggtcctctgggtcgcatccaggcccgggcgctgcagaaagttgtaaaaggagataagcccgctaaatatgagccgcgacaggaacctgtaggcaaactccaccgaagtctccccctgagtctttacaaagctgtcgtcacgcaacactgcctcgaaggcccggaacgtcccactaaacccaaaaaccagttttcgcaggcgcgcggtcaccgcgatctggctgttgaggacgtaagtgacgtcgttgcgggccacgaccagctgctgtttgctgtgcacctcgcagcgcatgtgccccgcgtcctggtcctggctctgcgagtagttggtgatgcggctggcgttggccgtgagccacttttcaatcgtcaggccgggctggtgtgtcagccgtcggtattcgtcaaactccttgaccgacacgaacgtaagcacggggagggtgaacacgacgaactccccctcacgggtcaccttcaggtaggcgtggagcttggccatgtacgcgctcacctctttgtgggaggagaacagccgcgtccagccggggaggttggcggggttggtgatgtagttttccgggacgacgaagcgatccacgaactgcatgtgctcctcggtgatgggcaggccgtactccagcaccttcatgaggttaccgaactcgtgctcgacgcaccgtttgttgttaataaaaatggcccagctatacgagaggcgggcgtactcgcgcagcgtgcggttgcagatgaggtacgtgagcacgttctcgctctggcggacggaacaccgcagtttctggtgctcgaaggtcgactccagggacgccgtctgcgtcggcgagcccacacacaccaacacgggccgcaggcgggccgcgtactggggggtgtggtacagggcgttaatcatccaccagcaatacaccacggccgtgaggaggtgacgcccaaggagcccggcctcgtcgatgacgatcacgttgctgcgggtaaaggccggcagcgccccgtgggtggccggggccaaccgcgtcagggcgccctcggccaaccccagggtccgttccagggcggccagggcgcgaaactcgttccgcaactcctcgcccccggaggcggccagggcgcgcttcgtgaggtccaaaatcacctcccagtagtacgtcagatctcgtcgctgcaggtcctccagcgaggcggggttgctggtcagggtgtacgggtactgtcccagttgggcctggacgtgattcccgcgaaacccaaattcatgaaagatggtgttgatgggtcggctgagaaaggcgcccgagagtttggcgtacatgttttgggccgcaatgcgcgtggcgcccgtcaccacacagtccaagacctcgttgattgtctgcacgcacgtgctctttccggagccagcgttgccggtgataagatacaccgcgaacggaaactccctgaggggcaggcctgcgggggactctaaggccgccacgtcccggaaccactgcagatggggcacttgcgctccgtcgagctgttgttgcgagagctctcggatgcgcttaaggattggctgcaccccgtgcatagacgtaaaatttaaaaaggcctcggccctccctggaacggctggtcggtccccgggttgctgaaggtgcggcgggccgggtttctgtccgtctagctggcgctccccgccggccgccgccatgaccgcaccacgctcgcgggcccccactacgcgtgcgcggggggacacggaagcgctgtgctcccccgaggacggctgggtaaaggttcaccccacccccggtacgatgctgttccgcgagattctccacgggcagctggggtataccgagggccagggggtgtacaacgtcgtccggtccagcgaggcgaccacccggcagctgcaggcggcgatctttcacgcgctcctcaacgccaccacttaccgggacctcgaggcggactggctcggccacgtggcggcccgcggtctgcagccccaacggctggttcgccggtacaggaacgcccgggaggcggatatcgccggggtggccgagcgggtgttcgacacgtggcggaacacgcttaggacgacgctgctggactttgcccacgggttggtcgcctgctttgcgccgggcggcccgagcggcccgtcaagcttccccaaatatatcgactggctgacgtgcctggggctggtccccatattacgcaagcgacaagaagggggtgtgacgcagggtctgagggcgtttctcaagcagcacccgctgacccgccagctggccacggtcgcggaggccgcggagcgcgccggccccgggttttttgagctggcgctggccttcgactccacgcgcgtggcggactacgaccgcgtgtatatctactacaaccaccgccggggcgactggctcgtgcgagaccccatcagcgggcagcgcggagaatgtctggtgctgtggccccccttgtggaccggggaccgtctggtcttcgattcgcccgtccagcggctgtttcccgagatcgtcgcgtgtcactccctccgggaacacgcgcacgtctgccggctgcgcaataccgcgtccgtcaaggtgctgctggggcgcaagagcgacagcgagcgcggggtggccggtgccgcgcgggtcgttaacaaggtgttgggggaggacgacgagaccaaggccgggtcggccgcctcgcgcctcgtgcggcttatcatcaacatgaagggcatgcgccacgtaggcgacattaacgacaccgtgcgtgcctacctcgacgaggccggggggcacctgatagacgccccggccgtcgacggtaccctccctggattcggcaagggcggaaacagccgcgggtctgcgggccaggaccagggggggcgggcgccgcagcttcgccaggccttccgcacggccgtggttaacaacatcaacggcgtgttggagggctatataaataacctgtttggaaccatcgagcgcctgcgcgagaccaacgcgggcctggcgacccaattgcaggagcgcgaccgcgagctccggcgcgcaacagcgggggccctggagcgccagcagcgcgcggccgacctggcggccgagtccgtgaccggtggatgcggcagccgccctgcgggggcggacctgctccgggccgactatgacattatcgacgtcagcaagtccatggacgacgacacgtacgtcgccaacagctttcagcacccgtacatcccttcgtacgcccaggacctggagcgcctgtcgcgcctctgggagcacgagctggtgcgctgttttaaaattctgtgtcaccgcaacaaccagggccaagagacgtcgatctcgtactccagcggggcgatcgccgcattcgtcgccccctactttgagtcagtgcttcgggccccccgggtaggcgcgcccatcacgggctccgatgtcatcctgggggaggaggagttatgggatgcggtgtttaagaaaacccgcctgcaaacgtacctgacagacatcgcggccctgttcgtcgcggacgtccagcacgcagcgctgcccccgcccccctccccggtcggcgccgatttccggcccggcgcgtccccgcggggccggtccagatcgcggtcgcccggaagaactgcgcgaggcgcgccggaccagggcgggggcatcgggcaccgggatggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgcacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttgaattttaggaaataaacccggttttgtttctgtggcctcccgacggatgcgcgtgtccttactccgtcttggtgggtgggtggctgtgtatggcgtcccatctgtgcggggaggggggcaagtcggcacgtattcggacagactcaagcacacacgggggagcgctcttgtctcagggcaatgtttttattggtcaaactcaggcaaacagaaacgacatcttgtcgtcaaagggatacacaaacttccccccctcgccccatactcccgccagcaccccggtaaacaccaactcaatctcgcgcaggatttcgcgcaggtgatgagcgcagtccacgggggggagcacaaggggccgcgggtatagatcgacggggacgccgaccgactccccgcctccgggacagacacgcacgacgcgccgccagtagtgctctgcgtccagcaaggcgccgccgcggaaggcagtggggggcaaggggtcgctggcctcaaagggggacacccgaacgctccagtactccgcgtccaaccgtttattaaacgcgtccaagataaggcggtcgcaggcgtcctccataaggccccgggccgtgagtgcgtcctcctccggcacgcatgccgttgtcaggcccaggacccgtcgcagcgtgtcgcgtacgacccctgccgccgtggtgtacgcgggcccgcggagaggaaatcccccaagatggtcagtgttgtcgcgggagttccagaaccacactcccgcctggctccaggcgactgcgtgggtgtagacgccctcgagggccaggcacagtgggtgccgcagccggaggccgttggccctaagcacggctcccacggccgtctcgatggcccgccgggcgtcctcgatcaccccggaagccgcatccgcgtcttgggggtccacgttaaagacaccccagaacgcacccccatcgcccccgcagaccgcgaacttcaccgagctggccgtctcctcgatctgcaggcagacggcggccattaccccacccaggagctgccgcagcgcagggcaggcgttgcacgtgtccgggaccaggcgctccaagacggccccggcccagggctctgagggagcggccaccaccagcgcgtccagtcttgctaggcccgtccggccgtgggggtccgccagcccgctccccccgaggtcggccagggccgccaggagctgggcgcgaagtccggggaagcaaaaccgcgccgtccagacgggcccgacggccgcgggcgggtctaacagttggatgattttagtggcgggatgccaccgcgccaccgcctcccgcaccgcgggcaggaggcatccggctgccgccgaggccacgccgggccaggctcgcggggggaggacgaccctggcccccaccgcgggccaggcccccaggagcgcggcgtaagcggccgcggccccgcgcaccaggtcccgtgccgactcggccgtggccggcacggtgaacgtgggccaacccggaaaccccaggacggcaaagtacgggacgggtcccccccggacctcaaactcgggccccagaaaggcaaagacgggggccagggccccgggggcggcgtggaccgtggtatgccactgccggaaaagggcgacgagcgccggcgcggagaacttctcgccggcgcttacaaagtagtcgtaatcgcggggcagcagcacccgtgccgtgactcgttgcgggtgcccgcgtggccgcaggcccacctcgcacacctcgaccaggtccccgaacgcgccctccttcttgatcggcggaaacgcaagagtctggtattcgcgcgcaaatagcgcggttccggtggtgatgttaacggtcagcgaagcggcggacgcgcactggggggtgtcgcgaatggccgccaggcgcgcccacgccagccgcgcgtcgggatgctcggcaacgcgcgccgccagggccatagggtcgatgtcaatgttggcctccgcgaccaggagagcggcgcgaggggcggcgggcgggccccacgacgctctctcaactttcaccaccagtcccgtgcgtgggtccgagccgatacgcagcggggcgaacagggccaccggcccggtctggcgctccagggccgccaggacgcacgcgtacagcgcccgccacagagtcgggttctccaggggctccagcggggaggcggccggcgtcgtcgcggcgcgggcggccgccacgacggcctggacggagacgtccgcggagccgtagaaatcccgcagctccgtcgcggtgacggagacctccgcaaagcgcgcgcgaccctcccctgcggcgttgcgacatacaaaatacaccagggcgtggaagtactcgcgagcgcgggggggcagccataccgcgtaaagggtaatggcgctgacgctctcctccacccacacgatatctgcggtgtccatcgcacggcccctaaggatcacgggcggtctgtgggtcccatgctgccgtgcctggccgggcccggtgggtcgcggaaaccggtgacggggggggggcggtttttggggttggggtgggggtgggaaacggcccgggtccgggggccaacttggcccctcggtgcgttccggcaacagcgccgccggtccgcggacgaccacgtaccgaacgagtgcggtcccgagacttatagggtgctaaagttcaccgccccctgcatcatgggccaggcctcggtggggagctccgacagcgccgcctccaggatgatgtcagcgttggggttggcgctggatgagtgcgtgcgcaaacagcgcccccacgcgggcacgcgtagcttgaagcgcgcgcccgcaaactcccgcttgtgggccataagcagggcgtacagctgcctgtgggtccggcaggcgctgtggtcgatgtggtgggcgtccaacaaccccacgattgtctgtttggtgaggtttttaacgcgccccgccccgggaaacgtctgcgtgcttttggccatctgcacgccaaacagttcgccccagattatcttgaacagcgccaccgcgtggtccgtctcgctaacggacccgcgcgggggacagccgcttagggcgtcggcgacgcgcttgacggcttcctccgagagcagaagtccgtcggttacgttacagtggcccagttcgaacaccagctgcatgtagcggtcgtagtggggggtcagtaggtccagcacgtcatcggggccgaaggtcctcccagatcccccggccgccgagtcccaatgcaggcgcgcggccatggtgctgcacaggcacaacagctcccagacgggggttacgttcagggtggggggcagggccacgagctccagctctccggtgacgttgatcgtggggatgacgcccgtggcgtagtggtcatagatccgccgaaatatggcgctgctgcgggtggccatgggaacgcggagacaggcctccagcaacgccaggtaaataaaccgcgtgcgtcccatcaggctgttgaggttgcgcatgagcgcgacaatttccgccggcgcgacatcggaccggaggtatttttcgacgaaaagacccacctcctccgtctcggcggcctgggccggcagcgacgcctcgggatcccggcaccgcagctcccgtagatcgcgctgggccctgagggcgtcgaaatgtacgccccgcaaaaacagacagaagtcctttggggtcagggtatcgtcgtgtccccagaagcgcacgcgtatgcagtttagggtcagcagcatgtgaaggatgttaaggctgtccgagagacacgccagcgtgcatctctcaaagtagtgtttgtaacggaatttgttgtagatgcgcgacccccgccccagcgacgtgtcgcatgccgacgcgtcacagcgccccttgaaccggcgacacagcaggtttgtgacctgggagaactgcgcgggccactggccgcaggaactgaccacgtgattaaggagcatgggcgtaaagacgggctccgagcgcgccccggagccgtccatgtaaatcagtagctcccccttgcggagggtgcgcacccgtcccagggactggtacacggacaccatgtccggtccgtagttcatgggtttcacgtaggcgaacatgccatcaaagtgcaggggatcgaagctgaggcccacggttacgaccgtcgtgtatataaccacgcggtattggccccacgtggtcacgtccccgaggggggtgagcgagtgaagcaacagcacgcggtccgtaaactgacggcagaaccgggccacgatctccgcgaaggagaccgtcgacgaaaaaatgcagatgttatcgcccccgccaaggcgcgcttccagctccccaaagaacgtggccccccgggcgtccggagaggcgtccggagacgggccgctcggcggcccgggcgggcgcagggcagcctgcaggagctcggtccccagacgcgggagaaacaggcaccggcgcgccgaaaacccgggcatggcgtactcgccgaccaccacatgcacgtttttttcgccccggagaccgcacaggaagtccaccaactgcgcgttggcggttgcgtccatggcgatgatccgaggacaggtgcgcagcaggcgtagcattaacgcatccacgcggcccagttgctgcatcgttggcgaatagagctggcccagcgtcgacataacctcgtccagaacgaggacgtcgtagttgttcagaaggttggggcccacgcgatgaaggctttccacctggacgataagtcggtggaaggggcggtcgttcataatgtaattggtggatgagaagtaggtgacaaagtcgaccaggcctgactcagcgaaccgcgtcgctagggtctgggtaaaactccgacgacaggagacgacgagcacactcgtgtccggagagtggatcgcttcccgcagccagcggatcagcgcggtagtttttcccgaccccattggcgcgcggaccacagtcacgcacctggccgtcggggcgctcgcgttggggaaggtgacgggtccgtgctgctgccgctcgatcgttgttttcgggtgaacccggggcacccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggtgtgtgcaggtggcgacgtttgtggtctctgcggtctgcgtcacggggctcctcgtcctggcctctgtgttccgggcacggtttccctgcttttacgccacggcgagctcttatgccggggtgaactccacggccgaggtgcgcgggggtgtagccgtgcccctcaggttggacacgcagagccttgtgggcacttatgtaatcacggccgtgttgttgttggccgtggccgtgtatgccgtggtcggcgccgtgacctcccgctacgaccgcgccctggacgcgggccgccgtctggctgcggcccgcatggccatgccgcacgccacgctgatcgccggaaacgtctgctcttggttgctgcagatcaccgtcctgttgctggcccatcgcatcagccagctggcccacctggtttacgtcctgcactttgcgtgtctggtgtattttgcggcccatttttgcaccaggggggtcctgagcgggacgtatctgcgtcaggtgcacggcctgatggagctggccccgacccatcatcgcgtcgtcggcccggctcgcgccgtgctgacaaacgccttgctgttgggcgtcttcctgtgcacggccgacgccgcggtatccctgaataccatcgccgcgttcaactttaatttttcggccccgggcatgctcatctgcctgaccgtgctgttcgccattctcgtcgtatcgctgttgttggtggtcgagggggtgttgtgtcactacgtgcgcgtgttggtgggcccccacctgggggccgtggccgccacgggcatcgtcggcctggcctgcgagcactattacaccaacggctactacgttgtggagacgcagtggccgggggctcagacgggagtccgcgtcgccctcgccctggtcgccgcctttgccctcggcatggccgtgctccgctgcacccgcgcctatctgtatcacaggcggcaccacaccaaattttttatgcgcatgcgcgacacgcgacaccgcgcacattccgccctcaagcgcgtacgcagttccatgcgcggatcgcgagacggccgccacaggcccgcacccggcagcccgcccgggattcccgaatatgcggaagacccctacgcgatctcatacggcggccagctcgaccggtacggagattccgacggggagccgatttacgacgaggtggcggacgaccaaaccgacgtattgtacgccaagatacaacacccgcggcacctgcccgacgacgatcccatctatgacaccgttggggggtacgaccccgagcccgccgaggaccccgtgtacagcaccgtccgccgttggtagctgtttggttccgttttaataaaccgtttgtgtttaacccgaccgtggtgtatgtctggtgtgtggcgtccgatcccgttactatcaccgtccccccccccccctcaaccccggcgattgtgggttttttaaaaacgacacgcgtgcgaccgtatacagaacattgttttggtttttattcgctatcggacatggggggtggaaactgggtggcggggcaggcgcctccgggggtccgccggtgagtgtggcgcgagggggggtccgatgaacgcaggcgctgtctccccggggcccgcgtaaccccgcgcatatccgggggcacgtagaaattaccttcctcttcggactcgatatccacgacgtcaaagtcgtgggcggtcagcgagacgacctccccgtcgtcggtgatgaggacgttgtttcggcagcagcagggccgggccccggagaacgagaggcccatagctcggcgagcgtgtcgtcgaatgccaggcggctgcttcgctggatggccttatagatctccggatcgatgcggacgggggtaatgatcagggcgatcggaacggcctggttcgggagaatggacgccttgctgggtcctgcggccccgagagccccggcgccgtcctccaggcggaacgttacgccctcctccgcgctggtgcggtgcctgccgataaacgtcaccagatgcgggtggggggggcagtcggggaagtggctgtcgagcacgtagccctgcaccaagatctgcttaaagttcgggtgacgggggttcgcgaagacgggctcgcggcggaccagatccccggagctccaggacacgggggagatggtgtggcgtccgaggtcgggggcgccaaacagaagcacctccgagacaacgccgctatttaactccaccaaggcccgatccgcggcggagcaccgccttttttcgcccgaggcgtgggcctctgaccaggcctggtcttgcgtgacgagagcctcctccgggccggggacgcgcccgggcgcgaagtatcgcacgctgggcttcgggatcgaccggataaatgcccggaacgcctccggggaccggtgtgccatcaagtcctcgtacgcggaggccgtggggtcgctggggtccatggggtcgaaagcgtacttggcccggcatttgacctcgtaaaaggccaggggggtcttggggactggggccaggtagccgtgaatgtcccgaggacagacgagaatatccagggacgccccgaccatccccgtgtgaccgtccatgaggaccccacacgtatgcacgttctcttcggcgaggtcgctgggttcgtggaagataaagcgccgcgtgtcggcgccggcctcgccgccgtcgtccgcgcggcccacgcagtagcgaaacagcaggcttcgggccgtcggctcgttcacccgcccgaacatcaccgccgaagactgtacatccggccgcaggctggcgttgtgcttcagccactggggcgagaaacacggaccctgggggccccagcggagggtggatgcggtcgtgaggccccgccggagcagggcccatagctggcagtcggcctggttttgcgtggccgcctcgtaaaaccccatgaggggccggggcgccacggcgtccgcggcggccgggggcccgcggcgcgtcaggcgccataggtgccgaccgagtccgcggtccaccatacccgcctcctcgaggaccacggccagggaacacagataatccaggcgggcccagaggggaccgatggccagaggggcgcggacgccgcgcagcaacccgcgcaggtggcgctcgaacgtctcggctagtatatgggagggcagcgcgttggggatcaccgacgccgaccacatagagtcaaggtccggggagtcgggatcggcgtccgggtcgcgggcgtgggtgcccccaggagatagcggaatgtctggggtcggaggccctgaggcgtcagaaagtgccggcgacgcggcccggggcttttcgtctgcggtgtcggtggcgtgctgatcacgtggggggttaacgggcgaatgggagctcgggtccacagctgacgtcgtctggggtggggggggcaggggacggaaggtggttgtcagcggaagactgttagggcgggggcgcttgggggggctgtcggggccacgaggggtgtcctcggccagggcccagggacgcttagtcacggtgcgtcccggcggacatgctgggcctaccgtggactccatttccgagacgacgtggggggagcggtggttgagcgcgccgccgggtgaacgctgattctcacgacagcgcgtgccgcgcgcacgggttggtgtgacacaggcgggacaccagcaccaggagaggcttaagctcgggaggcagcgccaccgacgacagtatcgccttgtgtgtgtgctggtaatttatacaccgatccgtaaacgcgcgccgaatcttgggattgcggaggtggcgccggatgccctctgggacgtcatacgccaggccgtgggtgttggtctcggccgagttgacaaacagggctgggtgcagcacgcagcgataggcgagcagggccagggcgaagtccggcgacagctggttgttaaaatactggtaaccgggaaaccgggtcacgggtacgcccaggctcggggcgacgtacacgctaaccaccaactccagcagcgtctggcccagggcgtacaggtcaaccgctaacccgacgtcgtgcttcaggcggtggttggtaaattcggcccgttcgttgttaaggtatttcaccaacagctccgggggctggttatacccgtgacccaccagggtgtgaaagttggctgtggttagggcggtgggcatgccaaacatccggggggacttgaggtccggctcctggaggcaaaactgcccccgggcgatcgtggagttggagttgagggtgacgaggctaaagtcggcgaggacggcccgccggagcgagacggcgtccgaccgcagcatgacgaggatgttggcgcacttgatatccaggtggctgatcccgcaggtggtgtttaaaaacacaacggcgcgggccagctccgtgaagcactggtggagggccgtcgagaccgaggggtttgttgtgcgcagggacgccagttggccgatatacttaccgaggtccatgtcgtacgcggggaacactatctgtcgttgttgcagcgagaacccgaggggcgcgatgaagccgcggatgttgtgggtgcggccggcgcgtagaacgcactccccgaccaacagggtcgcgatgagctcaacggcaaaccactccttttcctttatggtcttaacggcaagcttatgttcgcgaatcagttggacgtcaccgtatcccccagaccccccgaagcttcgggccccggggatctcgagggtcgtgtagtgtagggcggggttgatggcgaacacggggctgcatagcttgcggatgcgcgtgagggtgaggatgtgcgagggggacgaggggggtgcggttaacgccgcctgggatctgcgcaggggcgggcggttcagtttggccgccgtaccgggcgtctcgggggacgcgcggcgatgagacgagcggctcattcgccatcgggatagtcccgcgcgaagccgctcgcggaggccggatcggtggcgggacccgtgggaggagcgggagacggcggcgtcctggagagaggggccgctggggcgcccggaggccccgtgggggttggagtgtacgtaggatgcgagccaatccttgaaggaccgttggcgtgcaccttgggggctgaggttagctgccacatgaccagcaggtcgctgtctgcgggactcatccatccttcggccaggtcgccgtctccccacagagaagcgttggtcgctgcttcctcgagttgctcctcctggtccgcaagacgatcgtccacggcgtccaggcgctcaccaagcgccggatcgaggtaccgtcggtgtgcggttagaaagtcacgacgcgccgcttgctcctccacgcgaattttaacacaggtcgcgcgctgtcgcatcatctctaagcgcgcgcgggactttagccgcgcctccaattccaagtgggccgcctttgcagccataaaggcgccaacaaaccgaggatcttgggtgctgacgccctcccggtgcagctgcagggtctggtccttgtaaatctcggctcggaggtgcgtctcggccaggcgtcggcgcagggccgcgtgggcggcatctcggtccattccgccaccctgcgggcgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgaggcgtcggcgggcctcaccatgggcggcgatgccctacgagtgccctttttagatttcgcgaccgcgacccccaagcgccaccagaccgtggtccctggcgtcgggacgctccacgactgctgcgagcactcgccgctcttctcggccgtggcgcggcggctgctgtttaatagcctggtgccggcgcaactaaaggggcgtgatttcgggggcgaccacacggccaagctggaattcctggcccccgagttggtacgggcggtggcgcgactgcggtttaaggagtgcgcgccggcggacgtggtgcctcagcgtaacgcctactatagcgttctgaatacgtttcaggccctccaccgctccgaagcctttcgccagctggtgcactttgtgcgggactttgcccagctgctcaaaacctccttccgggcctccagcctcacggagaccacgggcccccccaaaaaacgggccaaggtggacgtggccacccacggccggacgtacggcacgctggagctgttccaaaaaatgatccttatgcacgccacctactttctggccgccgtgctcctcggggaccacgcggagcaggtcaacacgttcctgcgtctcgtgtttgagatccccctgtttagcgacgcggccgtgcgccacttccgccagcgcgccaccgtgtttctcgtcccccggcgccacggcaagacctggtttctggtgcccctcatcgcgctgtcgctggcctcctttcgggggatcaagatcggctacacggcgcacatccgcaaggcgaccgagccggtgtttgaggagatcgacgcctgcctgcggggctggttcggttcggcccgagtggaccacgttaaaggggaaaccatctccttctcgtttccggacgggtcgcgcagtaccatcgtgtttgcctccagccacaacacaaacgtaagtcctcttttctttcgcatggctctcccaaggggccccgggtcgacccgacccacacccacccacccacatacacacacaaccagacgcgggaggaaagtctgccccgtgggcactgatttttattcgggatcgcttgaggaggcccgggcaacggcccgggcaacggtggggcaactcgtagcaaataggcgactgatgtacgaagagaagacacacaggcgccacccggcgctggtcggggggatgttgtccgcgccgcaccgtcccccgacgacctcttgcagacggtccgtgatgcaaggacggcggggggcctgcagcagggtgaccgtatccacgggatggccaaagagaagcggacacaggctagcatccccctggaccgccagggtacactgggccatcttggcccacagacacggggcgacgcagggacaggactccgttacgacggaggagagccacagtgcgttggcggaatcgatgtggggcggcggggcgcaggactcgcagccccccgggtggttggtgatcctggccaggagccatcccagatggcgggccctgcttcccggtggacagagcgaccccaggtcgctgtccatggcccagcagtagatctggccgctggggaggtgccaccaggcccccgggcccaaggcgcagcacgcgcccggctccgggggggtcttcgcggggaccagatacgcgccatccagctcgccgaccactggctcctccgcgagctgttcggtggttgggtcgggggtttcctccgggggggtggccgcccgtatgcgtgcgaacgtgagggtgcacaggagcggggtcagggggtgcgtcacgctccggaggtggacgatcgcgcagtagcggcgctcgcggttaaagaaaaagagggcaaagaaggtgttcgggggcaaccgcagcgccttggggcgcgtcagatacagaaaaatctcgcagaagagggcgcgcccggggtctgggttaggaagggccacctgacacagaggctcggtgaggaccgttagacaccgaaagatcttgagccgctcgtccgcccgaacgacgcgccacacaaagacggagttgacaatgcgcgcgatagagtcgacgtccgtccccaggtcgtcgactctatcgcgcgtgccgcgagctccggcccgggaatccggccggggcaaggtccccgggggaccaggcggcgccaggggccgccggggtcccagctgcgccatgccgggggcggggggagggcaaaccccagaggcgggggccaacggcgcggggaggagtgggtgggcgaggtggccgggggaaggcgcccgctagcgagaccggccgttcccggacgacaccttgcgacaaaacctaaggacagcggcccgcgcgacggggtccgagaggctaaggtaggccgcgatgttaatggtgaacgcaaagccgccgggaaagacaactatgccacagaggcggcgattaaaccccaggcagaggtaggcgtagctttccccgggcaggtattgctcgcagaccctgcgtggggctgtggaggggacggcctccatgaagcgacatttactctgctcgcgtttactgacgtcaccatccatcgccacggcgattggacgattgttaagccgcagcgtgtctccgcttgtgctgtagtagtcaaaaacgtaatggccgtcggagtcggcaaagcgggccgggaggtcgtcgccgagcgggacgacccgccgcccccgaccgccccgtccccccaggtgtgccaggacggccagggcatacgcggtgtgaaaaaaggcgtcgggggcggtcccctcgacggcgcgcatcaggttctcgaggagaatggggaagcgcctggtcacctcccccaaccacgcgcgttggtcggggccaaagtcatagcgcaggcgctgtgagattcgcgggccgccctgaagcgcggcccggatggcctggcccagggcccggaggcacgccagatgtatgcgcgcggtaaaggcgacctcggcggcgatgtcaaagggcggcaggacggggcgcgggtggcgcaggggcacctcgagcgcgggaaagcgtagcagcagctccgcctgcccagcgggagacagctggtgggggcgcacgacgcgttctgcggcgcaggcctcggtcagggccgtggccagcgccgaggacagcagcggagggcgggcgcgtcgcccgccccacgccacggagttctcgtaggagacgacgacgaagcgctgcttggttccgtagtggtggcgcaggaccacggagatagaacgacggctccacagccagtccggccggtcgccgccggccagggcttcccatccgcgatccaaccactcgaccagcgaccgcggctttgcggtaccaggggtaagggttagaacgtcgttcaggatgtcctcgcccccgggcccgtggggcgctggggccacaaagcggcccccgccggggggctccagacccgccagcaccgcatctgcgtcagccgcccccatggcgcccccgctgacggcctggtgaaccagggcgccctggcgtagccccgatgcaacgccacaggccgcacgcccggtccgcgctcggaccgggtggcggcgggtgacgtcctgcactgcccgctgaaccaacgcgaggatctcctcgttctcctgtgcgatggacacgtcctgggccgcggtcgtgtcgccgccgggggccgtcagctgctcctccggggagatgggggggtcggacgccccgacgatgggcgggtctgcgggcgcccccgcgtggggccgggccaagggctgcggacgcggggacgcgctttcccccagacccatggacaggtgggccgcagcctccttcgcggccggcggggcggcggcgccaagcagagcgacgtagcggcacaaatgccgacagacgcgcatgatgcgcgtgctgtcggccgcgtagcgcgtgttgggggggacgagctcgtcgtaactaaacagaatcacgcgggcacagctcgcccccgagccccacgcaaggcgcagcgccgccacggcgtacgggtcatagacgccctgcgcgtcacacaccacgggcagggagacgaacaaccccccggcgctggacgcacgcggaaggaggccagggtgtgccggcacgacgggggccagaagctcccccaccgcatccgcgggcacgtaggcggcaaacgccgtgcaccacggggtacagtcgccggtggcatgagcccgagtctggatttcgacctggaagtttgcggccgtcccgagtccggggcggccgcgcatcagggcggccagagggattcccgcggccgccaggcactcgctggatatgatgacgtgaaccaaagacgagggccgacccgggccgtggccgagatcgtactggacctcgttggccaagtgcgcgttcatggttcgggggtgggtgtgggtgtgtaggcgatgcgggtcccccgagtccgcgggaagggcgtgggtttggcgcgcgtatgcgtattcgccaacggaggcgtgcgtgcttatgcgcggcgcgtttcttctgtctctagggaatccgaggccaggactttaacctgctctttgtcgacgaggccaactttattcgcccggatgcggtccagacgattatgggctttctcaaccaggccaactgcaagattatcttcgtgtcgtccaccaacaccgggaaggccagtacgagctttttgtacaacctccgcggggccgcagacgagcttctcaacgtggtgacctatatatgcgatgatcacatgccgagggtggtgacgcacacaaacgccacggcctgttcttgttatatcctcaacaagcccgttttcatcacgatggacggggcggttcgccggaccgccgatttgtttctggccgattccttcatgcaggagatcatcgggggccaggccagggagaccggcgacgaccggcccgttctgaccaagtctgcgggggagcggtttctgttgtaccgcccctcgaccaccaccaacagcggcctcatggcccccgatttgtacgtgtacgtggatcccgcgttcacggccaacacccgagcctccgggaccggcgtcgctgtcgtcgggcggtaccgcgacgattatatcatcttcgccctggagcacttttttctccgcgcgctcacgggctcggcccccgccgacatcgcccgctgcgtcgtccacagtctgacgcaggtcctggccctgcatcccggggcgtttcgcggcgtccgggtggcggtcgagggaaatagcagccaggactcggccgtcgccatcgccacgcacgtgcacacagagatgcaccgcctactggcctcggagggggccgacgcgggctcgggccccgagcttctcttctaccactgcgagcctcccgggagcgcggtgctgtacccctttttcctgctcaacaaacagaagacgcccgcctttgaacactttattaaaaagtttaactccgggggcgtcatggcctcccaggagatcgtttccgcgacggtgcgcctgcagaccgacccggtcgagtatctgctcgagcagctaaataacctcaccgaaaccgtctcccccaacactgacgtccgtacgtattccggaaaacggaacggcgcctcggatgaccttatggtcgccgtcattatggccatctacctcgcggcccaggccggacctccgcacacattcgctcctatcacacgcgtctcgtgagcgcccaataaacacacccaggtatgctacgcacgaccacggtgtcgtctgttaaggggggggggggaagggggtgttggcgggaagcgtgggaacacgggggattctctcacgaccggcaccagtaccacccccctgtgaacacagaaaccccaacccaaatcccataaacatacgacacacaggcatattttggaatttcttaggtttttatttatttaggtatgctggggtttctccctggatgcccacccccacccccccgtgggtctagccgggccttagggatagcgtataacgggggccatgtctccggaccgcacaacggccgcgccgtcaaaggtgcacacccgaaccacgggagccagggccaaggtgtctcctagttggcccgcgtgggtcagccaggcgacgagcgcctcgtaaagcggcagccttcgctctccatcctgcatcagggccggggcttcggggtgaatgagctgggcggcctcccgcgtgacactctgcatctgcagtagagcgttcacgtacccgtcctgggcacttagcgcaaagagccgggggattagcgtaaggatgatggtggttccctccgtgatcgagtaaaccatgttaaggaccagcgatcgcagctcggcgtttacgggaccgagttgttggacgtccgccagcagcgagaggcgactcccgttgtagtacagcacgttgaggtctggcagccctccggggtttctggggctggggttcaggtcccggatgcccctggccacgagccgcgccacgatttcgcgcgccaggggcgatggaagcggaacgggaaaccgcaacgtgaggtccagcgaatccaggcgcacgtccgtcgcttggccctcgaacacgggcgggacgaggctgatggggtccccgttacagagatctacgggggaggtgttgcgaaggttaacggtgccggcgtgggtgaggcccacgtccagggggcaggcgacgattcgcgtgggaagcacccgggtgatgaccgcggggaagcgccttcggtacgccagcaacaaccccaacgtgtcgggactgacgcctccggagacgaaggattcgtgcgccacgtcggccagcgtcagttgccggcggatggtcggcaggaataccacccgcccttcgcagcgctgcagcgccgccgcatcggggcgcgagatgcccgagggtatcgcgatgtcagtttcaaagccgtccgccagcatggcgccgatccacgcggcagggagtgcagtggtggttcgggtggcgggaggagcgcggtgggggtcagcggcgtagcagagacgggcgaccaacctcgcataggacggggggtgggtcttagggggttgggaggcgacagggaccccagagcatgcgcggggaggtctgtcgggcccagacgcaccgagagcgaatccgtccgcggagtcccggcttgggttttatggggcccggccctcggaatcgcggcttgtcggcggggacaaagggggcggggctaggggcttgcggaaacagaagacgcgtgggataaaagaatcgcactaccccaaggaagggcggggcggtttattacagagccagtcccttgagcggggatgcgtcatagacgagatactgcgcgaagtgggtctcccgcgcgtgggcttccccgttgcgggcactgcggaggagggcggggtcgctggcgcaggtgagcgggtaggcctcctgaaacaggccacacgggtcctccacgagttcgcggcaccccggggggcgcttaaactgtacgtcgctggcggcggtggccgtggacaccgccgaacccgtctccacgatcaggcgctccaggcagcgatgtttggcggcgatgtcggccgacgtaaagaacttaaagcaggggctgagcaccggcgaggccccgttgaggtggtaggccccgttatagagcaggtccccgtacgaaaatcgctgcgacgcccacgggttggccgtggccgcgaaggcccgggacgggtcgctctggccgtggtcgtacatgagggcggtgacatccccctccttgtcccccgcgtaaacgcccccggcggcgcgtccccgggggttgcagggccggcggaagtagttgacgtcggtcgacacgggggtggcgataaactcacacacggcgtcctggccgtggtccatccctgcgcgccgcggcacctgggcgcacccgaacacggggacgggctgggccggccccaggcggtttcccgccacgaccgcgttccgcaggtacacggctgccgcgttgtccaggagagggggagccccgcggcccaggtaaaagttttggggaaggttgcccatgtcggtgacggggttgcggacggttgccgtggccacgacggcggtgtagcccacgcccaggtccacgttcccgcgcggctgggtgagcgtgaagtttacccccccgccagtttcgtgccgggccacctggagctggcccaggaagtacgcctccgacgcgcgctccgagaacagcacgttctcagtcacaaagcggtcctgtcggacgacggtgaacccaaacccgggatggaggcccgtcttgagctgatgatgcaaggccacgggactgatcttgaagtaccccgccatgagcgcgtaggtcagcgcgttctccccggccgcgctctcgcggacgtgctgcacgacgggctgtcggatcgacgaaaagtagttggcccccagagccggggggaccagggggacctgccgcgacaggtcgcgcagggccggggggaaattgggcgcgttcgccacgtggtcggccccggcgaacagcgcgtggacggggagggggtaaaaatagtcgccattttggatggtatggtccagatgctggggggccatcagcaggattccggcgtgcaacgccccgtcgaatatgcgcatgttggtggtggacgcggtgttggcgcccgcgtcgggcgccgccgagcagagcagcgccgttgtgcgttcggccatgttgtgggccagcacctgcagcgtgagcatggcgggcccgtccactaccacgcgcccgttgtgaaacatggcgttgaccgtgttggccaccagattggccgggtgcagggggtgcgcggggtccgtcacggggtcgctggggcactcctcgccgggggcgatctccgggaccaccatgttctgcagggtggcgtatacgcggtcgaagcgaacccccgcggtgcagcagcggccccgcgagaaggcgggcaccatcacgtagtagtaaatcttgtggtgcacggtccagtccgccccccggtgcggccggtcatccgcggcgtccgcggctcgggcctgggtgttgtgcagcagctggccgtcgttgcggttgaagtccgcggtcgccacgttacatgccgccgcgtacacggggtcgtggccccccgcgctaacccggcagtcgcgatggcggtccagggccgcgcgccgcatcagggcgtcacagtcccacacgaggggtggcagcagcgccgggtctcgcattaggtgattcagctcggcttgcgcctgcccgcccagctccgggccggtcagggtaaagtcatcaaccagctgggccagggcctcgacgtgcgccaccaggtcccggtacacggccatgcactcctcgggaaggtctcccccgaggtaggtcacgacgtacgagaccagcgagtagtcgttcacgaacgccgcgcaccgcgtgttgttccagtagctggtgatgcactggaccacgagccgggccagggcgcagaagacgtgctcgctgccgtgtatggcggcctgcagcaggtaaaacaccgccgggtagttgcggtcgtcgaacgccccgcgaacggcggcgatggtggcgggggccatggcgtggcgtcccacccccagctccaggccccgggcgtcccggaacgccgccggacatagcgccaggggcaagttgccgttcaccacgcgccaggtggcctggatctcccccgggccggccgggggaacgtccccccccggcagctccacgtcggccacccccacaaagaagtcgaacgcggggtgcagctcaagagccaggttggcgttgtcgggctgcataaactgctccggggtcatctggccttccgcgacccatcggacccgcccgtgggccaggcgctgcccccaggcgttcaaaaacagctgctgcatgtctgcggcggggccggccggggccgccacgtacgccccgtacggattggcggcttcgacggggtcgcggttaaggcccccgaccgccgcgtcaacgttcatcagcgaagggtggcacacggtcccgatcgcgtgttccagagacaggcgcagcacctggcggtccttcccccaaaaaaacagctggcggggcgggaaggcgcggggatccgggtggccgggggcggggactaggtccccggcgtgcgcggcaaaccgttccatgaccggattgaacaggcccaggggcaggacgaacgtcaggtccatggcgcccaccagggggtagggaacgttggtggcggcgtagatgcgcttctccagggcctccagaaagaccagcttctcgccgatggacaccagatccgcgcgcacgcgcgtcgtctggggggcgctctcgagctcgtccagcgtctgccggttcaggtcgagctgctcctcctgcatctccagcaggtggcggcccacgtcgtccagacttcgcacggccttgcccatcacgagcgccgtgaccaggttggccccgttcaggaccatctcgccgtacgtcaccggcacgtcggcttcggtgtcctccactttcaggaaggactgcaggaggcgctgtttgatcggggcggtggtgacgagcaccccgtcgaccggccgcccgcgcgtgtcggcatgcgtcagacggggcacggccacggagggctgcgtggccgtggtgaggtccacgagccaggcctcgacggcctcccggcggtggcccgccttgcccaggaaaaagctcgtctcgcagaagcttcgctttagctcggcgaccagggtcgcccgggccaccctggtggccaggcggccgttgtccaggtatcgttgcatcggcaacaacaaagccaggggcggcgccttttccagcagcacgtgcagcatctggtcggccgtgccgcgctcaaacgccccgaggacggcctggacgttgcgagcgagctgttggatggcgcgcaactggcgatgcgcgccgatacccgtcccgtccagggcctcccccgtgagcagggcgatggcctcggtggccaggctgaaggcggcgttcagggcccggcggtcgataatcttggtcatgtaattgtgtgtgggttgctcgatggggtgcgggccgtcgcgggcaatcagcggctggtggacctcgaactgtacgcgcccctcgttcatgtaggccagctccggaaacttggtacacacgcacgccaccgacaacccgagctccagaaagcgcacgagcgacagggtgttgcaatacgaccccagcagggcgtcgaactcgacgtcgtacaggctgtttgcatcggagcgcacgcgggaaaaaaaatcaaacaggcgtcgatgcgacgccacctcgatcgtgctaaggagggacccggtcggcaccatggccgcggcataccggtatcccggagggtcgcggttgggagcggccatggggtcgcgtggagatcggctgtctctagcgatattggcccggggaggctaagatccaccccaacgcccggccacccgtgtacgtgcccgacggcccaaggtccaccgaaagacacgacgggcccggacccaaaaaggcgggggatgctgtgtgagaggccgggtgccggtcgggggggaaaggcaccgggagaaggctgcggcctcgttccaggagaacccagtgtccccaacagacccggggacgtgggatcccaggccttatatacccccccccccgccccacccccgttagaacgcgacgggtgcattcaagatggccctggtccaaaagcgtgccaggaagaaattggcagaggcggcaaagctgtccgccgccgccacccacatcgaggccccggccgcgcaggctatccccagggcccgtgtgcgcaggggatcggtgggcggcagcatttggttggtggcgataaagtggaaaagcccgtccggactgaaggtctcgtgggcggcggcgaacaaggcacacagggccgtgcctcccaaaaacacggacatcccccaaaacacgggcgccgacaacggcagacgatccctcttgatgttaacgtacaggaggagcgcccgcaccgcccacgtaacgtagtagccgacgatggcggccaggatacaggccggcgccaccacccttccggtcagcccgtaatacatgcccgctgccaccatctccaacggcttcaggaccaaaaacgaccaaaggaacagaatcacgcgctttgaaaagaccggctgggtatggggcggaagacgcgagtatgccgaactgacaaaaaaatcagaggtgccgtacgaggacaatgaaaactgttcctccagcggcagttctccctcctcccccccgaaggcggcctcgtcgaccagatctcgatccaccagaggaaggtcatcccgcatggtcatggggtgtgcggtggaggtggggagaccgaaaccgcaaagggtcgcttacgtcagcaggatcccgagatcaaagacacccgggttcttgcacaaacaccacccgggttgcatccgcggaggcgagtgttttgataaggccgttccgcgccttgatataacctttgatgttgaccacaaaacccggaatttacgcctacgccccaatgcccacgcaagatgaggtaggtaacccccccgtgggtgtgacgttgcgtttagttcattggaggccaaggggaaaaatggggtggggaggaaacggaaaacccagtaggccgtgtcgggaacacgcccggggttgtcctcaaaaggcagggtccatactacggaagccgtcgttgtattcgagacctgcctgtgcaacgcacgtcggggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaaaagaccccaataaacgtatatcgctactacacccttgtgtgtcaatggacgcctctccgggggggggggagggaaagcaaagaggggctgggggagcggcaccaccggggcctgaacaaacaaaccacagacacggttacagtttattcggtcgggcggagaaacggccgaagccacgcccactttattcgcgtctccaaaaaaacgggacacttgtccggagaacctttaggatgccagccagggcggcggtaatcataaccacgcccagcgcagaggcggccagaaacccgggcgcaattgcggccacgggctgcgtgtcaaaggctagcaaatgaatgacggttccgtttggaaatagcaacaaggccgtggacggcacgtcgctcgaaaacacgcttggggcgccctccgtcggcccggcggcgatttgctgctgtgtgttgtccgtatccaccagcaacacagacatgacctccccggccggggtgtagcgcataaacacggcccccacgagccccaggtcgcgctggttttgggtgcgcaccagccgcttggactcgatatcccgggtggagccttcgcatgtcgcggtgaggtaggttaggaacagtgggcgtcggacgtcgacgccggtgagcttgtagccgatcccccggggcagaggggagtgggtgacgacgtagctggcgttgtgggtgatgggtaccaggatccgtggctcgacgttggcagactgccccccgcaccgatgtgaggcctcagggacgaaggcgcggatcagggcgttgtagtgtgcccaacgcgtcagggtcgaggcgaggccgtgggtctgctgggccaggacttcgaccggggtctcggatcgggtggcttgagccagcgcgtccaggataaacacgctctcgtctagatcaaagcgcagggaggccgcgcatggcgaaaagtggtccggaagccaaaagagggttttctggtggtcggcccgggccagcgcggtccggaggtcggcgttggtcgctgcggcgacgtcggacgtacacagggccgaggctatcagaaggctccggcgggcgcgttcccgctgcaccgccgaggggacgccagccaagaacggctgccggaggacagccgaggcgtaaaatagcgcccggtggacgaccggggtggtcagcacgcggccccctagaaactcggcatacagggcgtcgatgagatgggctgcgctgggcgccactgcgtcgtacgccgaggggctatccagcacgaaggccagctgatagcccagcgcgtgtaatgccaagctctgttcgcgctccagaatctcggccaccaggtgctggagccgagcctctagctgcaggcgggccgtgggatccaagactgacacattaaaaaacacagaatccgcggcacagcccgcggccccgcgggcggccaacccggcaagcgcgcgcgagtgggccaaaaagcctagcaggtcggagaggcagaccgcgccgtttgcgtgggcggcgttcacgaaagcaaaacccgacgtcgcgagcagccccgttaggcgccagaagagaggggggcgcgggccctgctcggcgcccgcgtcccccgagaaaaactccgcgtatgcccgcgacaggaactgggcgtagttcgtgccctcctccgggtagccgcccacgcggcggagggcgtccagcgcggagccgttgtcggcccgcgtcagggaccctaggacaaagacccgataccgggggccgcccgggggcccgggaagagcccccggggggttttcgtccgcggggtccccgacccgatctagcgtctggcccgcggggaccaccatcacttccaccggagggctgtcgtgcatggatatcacgagccccatgaattcccgcccgtagcgcgcgcgcaccagcgcggcatcgcacccgagcaccagctcccccgtcgtccagatgcccacgggccacgtcgaggccgacggggagaaatacacgtacctacctggggatctcaacaggccccgggtggccaaccaggtcgtggacgcgttgtgcaggtgcgtgatgtccagctccgtcgtcgggtgccgccgggccccaaccggcggtcgggggggcggtgtatcacgcggcccgctcgggtggctcgccgtcgccacgttgtctccccgcgggaacgtcagggcctcggggtcagggacggccgaaaacgttacccaggcccgggaacgcagcaacacggaggcggctggattgtgcaagagacccttaaggggggcgaccgaggggggaggctgggcggtcggctcgaccgtggtgggggcgggcaggctcgcgttcgggggccggccgagcaggtaggtcttcgggatgtaaagcagctggccggggtcccgcggaaactcggccgtggtgaccaatacaaaacaaaagcgctcctcgtaccagcgaagaaggggcagagatgccgtagtcaggtttagttcgtccggcggcgccagaaatccgcgcggtggtttttgggggtcgggggtgtttggcagccacagacgcccggtgttcgtgtcgcgccagtacatgcggtccatgcccaggccatccaaaaaccatgggtctgtctgctcagtccagtcgtggacctgaccccacgcaacgcccaaaataataacccccacgaaccataaaccattccccatgggggaccccgtccctaacccacggggcccgtggctatggcagggcttgccgccccgacgttggctgcgagccctgggccttcacccgaacttgggggttggggtggggaaaaggaagaaacgcgggcgtattggtcccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccatctcccgggcaaacgtgcgcgccaggtcgcagatcgtcggtatggagcctggggtggtgacgtgggtctggaccatcccggaggtaagttgcagcagggcgtcccggcagccggcgggcgattggtcgtaatccaggataaagacgtgcatgggacggaggcgtttggccaagacgtccaaagcccaggcaaacacgttatacaggtcgccgttgggggccagcaactcgggggcccgaaacagggtaaataacgtgtccccgatatggggtcgtgggcccgcgttgctctggggctcggcaccctggggcggcacggccgcccccgaaagctgtccccaatcctcccgccacgacccgccgccctgcagataccgcaccgtattggcaagcagcccataaacgcggcgaatcgcggccagcatagccaggtcaagccgctcgccggggcgctggcgtttggccaggcggtcgatgtgtctgtcctccggaagggcccccaacacgatgtttgtgccgggcaaggtcggcgggatgagggccacgaacgccagcacggcctggggggtcatgctgcccataaggtatcgcgcggccgggtagcacaggagggcggcgatgggatggcggtcgaagatgagggtgagggccgggggcggggcatgtgagctcccagcctcccccccgatatgaggagccagaacggcgtcggtcacggcataaggcatgcccattgttatctgggcgcttgtcattaccaccgccgcgtccccggccgatatctcaccctggtcgaggcggtgttgtgtggtgtagatgttcgcgattgtctcggaagcccccaacacccgccagtaagtcatcggctcgggtacgtagacgatatcgtcgcgcgaacccagggccaccagcagttgcgtggtggtggttttccccatcccgtggggaccgtctatataaacccgcagtagcgtgggcattttctgctccaggcggacttccgtggctttttgctgccggcgagggcgcaacgccgtacgtcggttgttatggccgcgagaacgcgcagcctggtcgaacgcagacgcgtgttgatggcaggggtacgaagccatacgcgcttctacaaggcgctggccgaagaggtgcgggagtttcacgccaccaagatctgcggcacgctgttgacgctgttaagcgggtcgctgcagggtcgctcggtattcgaggccacacgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagtccctcgcgcctccgggtgacaagatagtgtacctgtgccccgtcctggtgtttgtcgcccaacggacgctccgcgtcagccgcgtgacccggctcgtcccgcagaaggtctccggtaatatcaccgcagtcgtgcggatgctccagagcctgtccacgtatacggtccccattgagcctaggacccagcgagcccgtcgccgccgcggcggcgccgcccgggggtctgcgagcagaccgaaaaggtcacactctggggcgcgcgacccgcccgagtcagcggcccgccagttaccacccgccgaccaaacccccgcctccacggagggcgggggggtgcttaagaggatcgcggcgctcttctgcgtgcccgtggccaccaagaccaaaccccgagccgcctccgaatgagagtgtttcgttccttccccctccccccgcgtcagacaaaccctaaccaccgcttaagcggcccccgcgaggtccgaagactcatttggatccggcgggagccacccgacaacagcccccgggttttcccacgccagacgccggtccgctgtgccatcgcgccccctcatcccaccccccatcttgtccccaaataaaacaaggtctggtagttaggacaacgaccgcagttctcgtgtgttattttcgctctccgcctctcgcagatggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttagtgggtggtgggcgaggggggagggggcattagggagaaagaacaagagcctccgttgggttttctttgtgcctgtactcaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgcatggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgggccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctgattcgccccggtctttggtaccatgggatgtcttactgtatatctttttaaataaaccaggtaataccaaataagacccattggtgtatgttctttttttattgggaggcgcgggtaggcgggtagctttacaatgcaaaagccttcgacgtggaggaaggcgtggggggggggggaatcggcactgaccaagggggtccgttttgtcacgggaaaggaaagaggaaacaggccgcggacacccgggggagtttgtgttcccttttctttcttcccacacacacaaaaggcgtaccaaacaaacaaaccaaaagatgcacatgcggtttaacacccgtggtttttatttacaacaaaccccccatcacaggtcgtcctcgtcggcgtcaccgtctttgttgggaacttgggtgtagttggtgttgcggcgcttgcgcatgaccatgtcggtgaccttggcgctgagcagcgcgctcgtgcccttcttcttggccttgtgttccgtgcgctccatggcagacaccagggccatgtaccgtatcatctcccgggcctcggctagcttggcctcgtcaaagtcgccgccctcctcgccctccccggacgcgtccgggttggtggggttcttgagctccttggtggttagcgggtacagggccttcatggggttgctctgcagccgcatgacgtagcgaaaggcgaagaaggccgccgccaggccggccaggaccaacagacccacggccagcgccccaaaggggttggacatgaaggaggacacgcccgacacggccgataccacgccgcccacgatgcccatcaccaccttgccgaccgcgcgccccaggtcgcccatcccctcgaagaacgcgcccaggcccgcaaacatggcggcgttggcgtcggcgtggatgaccgtgtcgatgtcggcgaagcgcaggtcgtgcagctggttgcggcgctggacctccgtgtagtccagcaggccgctgtccttgatctcgtggcgggtgtacacctccagggggacaaactcgtgatcctccagcatggtgatgttgaggtcgatgaaggtgctgacggtggtgatgtcggcgcggctcagctggtgggagtacgcgtactcctcgaagtacacgtagcccccaccgaaggtgaagtagcgccggtgtcccacggtgcacggctcgatcgcatcgcgcgtcagccgcagctcgttgttctcccccagctgcccctcgaccaacgggccctggtcttcgtaccgaaagctgaccagggggcggctgtagcaggccccgggccgcgagctgatgcgcatcgagttttggacgatcacgttgtccgcggcgaccggcacgcacgtggagacggccatcacgtcgccgagcatccgcgcgctcacccgccggcccacggtggccgaggcgatggcgttggggttcagcttgcgggcctcgttccacagggtcagctcgtgattctgcagctcgcaccacgcgatggcaacgcggcccaacatatcgttgacatggcgctgtatgtggttgtacgtaaactgcagcctggcgaactcgatggaggaggtggtcttgatgcgctccacggacgcgttggcgctggccccgggcggcgggggcgtggggtttgggggcttgcggctctgctcgcggaggtgttcccgcacgtacagctccgcgagcgtgttgctgagaaggggctggtacgcgatcagaaagcccccattggccaggtagtactgcggctggcccaccttgatgtgcgtcgcgttgtacctgcgggcgaagatgcggtccatggcgtcgcgggcgtccttgccgatgcagtcccccaggtccacgcgcgagagcgggtactcggtcaggttggtggtgaaggtggtggatatggcgtcggaagagaatcggaaggagccgccgtactcggagcgcagcatctcgtccacctcctgccacttggtcatggtgcagaccgacgggcgctttggcacccagtcccaggccacggtgaacttgggggtcgtgagcaggttccgggtggtcggcgccgtggcccgggccttggtggtgaggtcgcgcgcgtagaagccgtcgacctgcttgaagcggtcggcggcgtagctggtgtgttcggtgtgcgacccctcccggtagccgtaaaacggggacatgtacacaaagtcgccagtcgccaacacaaactcgtcgtacgggtacaccgagcgcgcgtccacctcctcgacgatgcagtttaccgtcgtcccgtaccggtggaacgcctccacccgcgaggggttgtacttgaggtcggtggtgtgccagccccggctcgtgcgggtcgcggcgttggccggtttcagctccatgtcggtctcgtggtcgtcccggtgaaacgcggtggtctccaggttgttgcgcacgtacttggccgtggaccgacagacccccttggcgttgatcttgtcgatcacctcctcgaaggggacgggggcgcggtcctcaaagatccccataaactgggagtagcggtggccgaaccacacctgcgaaacggtgacgtctttgtagtacatggtggccttgaacttgtacggggcgatgttctccttgaagaccaccgcgatgccctccgtgtagttctgaccctcgggccgggtcgggcagcggcgcggctgctcgaactgcaccaccgtggcgcccgtggggggtgggcacacgtaaaagtttgcatcggtgttctccgccttgatgtcccgcaggtgctcgcgcagggtggcgtggcccgcggcgacggtcgcgttgtcgccggcggggcgcggcggctttgggggtttcggttttttgttcttcttcggtttcgggtcccccgttgggggggcgccaggggcgggcggcgccggagtggcagggcccccgttcgccgcctgggtcgcggccgcgaccccaggcgtgccgggggaactcggagccgccgacgccaccaggacccccagcgtcaaccccaagagcgcccatacgacgaaccaccggcgcccccgcgcgggggcgccctggcgcatggcgggactacgggggcccgtcgtgccccccgtcaggtagcctgggggcgaggtgctggaggaccgagtagaggatcgagaaaacgtctcggtcgtagaccacgaccgaccgggggccgatacagccgtcgggggcgctctcgacgatggccaccagcggacagtcggagtcgtacgtgagatatacgccgggcgggtaacggtaacgaccttcggaggtcgggcggctgcagtccgggcggcgcaactcgagctccccgcaccggtagaccgaggcaaagagtgtggtggcgataatcagctcgcgaatatatcgccaggcggcgcgctgagtgggcgttattccggaaatgccgtcaaaacagtaaaacctctgaaattcgctgacggcccaatcagcacccgagccccccgcccccatgatgaaccgggcgagctcctccttcaggtgcggcaggagccccacgttctcgacgctgtaatacagcgcggtgttggggggctgggcgaagctgtgggtggagtgatcaaagaggggcccgttgacgagctcgaagaagcgatgggtgatgctggggagcagggccgggtccacctggtgtcgcaggagagacgctcgcatgaaccggtgcgcgtcgaacacgcccggcgccgagcggttgtcgatgaccgtgcccgcgcccgccgtcagggcgcagaagcgcgcgcgcgccgcaaagccgttggcgaccgcggcgaacgtcgcgggcagcacctcgccgtggacgctgacccgcagcatcttctcgagctccccgcgctgctcgcggacgcagcgccccaggctggccaacgaccgcttcgtcaggcggtccgcgtacagccgccgtcgctcccgcacgtccgcggccgcttgcgtggcgatgtccccccacgtctcgggcccctgccccccgggcccgcggcgacggtcttcgtcctcgcccccgcccccgggagctcccaacccccgtgccccttcctctacggcgacacggtccccgtcgtcgtcggggcccgcgccgcccttgggcgcgtccgccgcgccccccgcccccatgcgcgccagcacgcgacgcagcgcctcctcgtcgcactgttcggggctgacgaggcgccgcaagagcggcgtcgtcaggtggtggtcgtagcacgcgcggatgagcgcctcgatctgatcgtcgggtgacgtggcctgaccgccgattattagggcgtccaccatatccagcgccgccaggtggctcccgaacgcgcgatcgaaatgctccgcccgccgcccgaacagcgccagttccacggccaccgcggcggtctcctgctgcaactcgcgccgcgccagcgcggtcaggttgctggcaaacgcgtccatggtggtctggccggcgcggtcgccggacgcgagccagaatcgcaattcgctgatggcgtacaggccgggcgtggtggcctgaaacacgtcgtgcgcctccagcagggcgtcggcctccttgcggaccgagtcgttctcgggcgacgggtggggctgcccgtcgccccccgcggtccgggccagcgcatggtccaacacggagagcgcccgcgcgcggtcggcgtccgacagcccggcggcgtggggcaggtaccgccgcagctcgttggcgtccagccgcacctgcgcctgctgggtgacgtggttacagatacggtccgccaggcggcgggcgatcgtcgccccctggttcgccgtcacacacagttcctcgaaacagaccgcgcaggggtgggacgggtcgctaagctccggggggacgataaggcccgaccccaccgcccccaccataaactcccgaacgcgctccagcgcggcggtggcgccgcgcgagggggtgatgaggtggcagtagtttagctgctttagaaagttctcgacgtcgtgcaggaaacacagctccatatggacggtcccgccatacgtatccagcctgacccgttggtgatacggacagggtcgggccaggcccatggtctccgtgaaaaacgccgcgacgtctcccgcggtcgcgaacgtctccaggctgcccaggagccgctcgccctcgcgccacgcgtactctagcagcaactccagggtgaccgacagcggggtgagaaaggccccggcctgggcctccaggcccggcctcagacgacgccgcagcgcccgcacctgaagcgcgttcagcttcagttgggggagcttcccccgtccgatgtgggggtcgcaccgccggagcagctctatctgaaacacataggtctgcacctgcccgagcagggctaacaacttttgacgggccacggtgggctcggacaccggggcggccatctcgcggcgccgatctgtaccgcggccggagtatgcggtggaccgaggcggtccgtacgctacccggcgtctggctgagccccggggtccccctcttcggggcggcctcccgcgggcccgccgaccggcaagccgggagtcggcggcgcgtgcgtttctgctctattcccagacaccgcggagaggaatcacggcccgcccagagatatagacacggaacacaaacaagcacggatgtcgtagcaataatttattttacacacattccccgccccgccctaggttcccccaccccccaacccctcacagcatatccaacgtcaggtctccctttttgtcggggggcccctccccaaacgggtcatccccgtggaacgcccgtttgcggccggcaaatgccggtcccggggcccccgggccgccgaacggcgtcgcgttgtcgtcctcgcagccaaaatccccaaagttaaacacctccccggcgttgccgagttggctgactagggcctcggcctcgtgcgccacctccagggccgcgtccgtcgaccactcgccgttgccgcgctccagggcacgcgcggtcagctccatcatctcctcgcttaggtactcgtcctccaggagcgccagccagtcctcgatctgcagctgctgggtgcggggccccaggcttttcacggtcgccacgaacacgctactggcgacggccgccccgccctcggagataatgccccggagctgctcgcacagcgagctttcgtgcgctccgccgccgaggcttgaggccgcgcacacaaacccggcccggggacaggccaggacgaacttgcgggtgcggtcaaaaataaggagcgggcacgcgtttttgccgcccatcaggctggcccagttcccggcctgaaacacacggtcgttgccggccatgccgtagtacttgctgatgctcaaccccaacacgaccatggggcgcgccgccatgacgggccgcagcaggttgcagctggcgaacatggacgtccacgcgcccggatgcgcgtccacggcgtccatcagcgcgcgggccccggcctccaggcccgccccgccctgcgcggaccacgcggccgcagcctgcacgctggggggacggcgggaccccgcgatgatggccgtaagggtgttgatgaagtatgtcgagtgatcgcagtaccgcagaatctggtttgccatgtagtacatcgccagctcgctcacgttgttgggggccaggttaataaagtttatcgcgccgtagtccagggaaaactttttaatgaacgcgatggtctcgatgtcctcgcgcgacaggagccgggcgggaagctggttgcgttggagggccgtccagaaccactgcgggttcggctggttggaccccgggggcttgccgttggggaagatggccgcgtggaactgcttcagcagaaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagctccttgggaaaccccagggtcacgcgggcaacgtcgccctcgaagctgctctcggcgggggccgtctggccggccgttaggctgggggcgcagatagccgccccctccgagagcgcgaccgtcagcgttttggccgacagaaacccgttgttaaacatgtccatcacgcgccgccgcagcaccggttggaattgattgcgaaagttgcgcccctcgaccgactgcccggcgaacaccccgtggcactgactcagggccaggtcctggtacacggcgaggttggatcgccgcccgagaagctgaagcagggggcacggcccgcacgcgtacgggtccagcgtcagggacatggcgtggttggcctcgcccagaccgtcgcgaaacttgaagttcctcccctccaccaggttgcgcatcagctgctccacctcgcggtccacgacctgcctgacgttgttcaccaccgtatgcagggcctcgcggttggtgatgatggtctccagccgccccatggccgtggggaccgcctggtccacgtactgcagggtctcgagttcggccatgacgcgctcggtcgccgcgcggtacgtctcctgcatgatggtccgggcggtctcggatccgtccgcgcgcttcagggccgagaaggcggcgtagtttcccagcacgtcgcagtcgctgtacatgctgttcatggtcccgaagacgccgatggctccgcgggcggcgctggcgaactttggatggcgcgcccggaggcgcatgagcgtcgtgtgtacgcaggcgtggcgcgtgtcgaaggtgcataggttacagggcacgtcggtctggttggagtccgcgacgtatcgaaacacgtccatctcctggcgcccgacgatcacgccgccgtcgcagcgctccaggtaaaacagcatcttggccagcagcgccggggaaaacccacacagcatggccaggtgctcgccggcaaattcctgggttccgccgacgaggggcgcggtgggccgaccctcgaacccgggcaccacgtgtccctcgcggtccacctgtgggttggccgccacgtgggtcccgggcacgaggaagaagcggtaaaaggagggtttgctgtggtcctttgggtccgccgggccggcgtcgtccacctcggtgagatggagggccgagttggtgctaaataccatggcccccacgagtcccgcggcgcgcgccaggtacgccccgacggcgttggcgcgggccgcggccgtgtcctggccctcgaacagcggccacgcggagatgtcggtgggcggctcgtcaaagacggccatcgacacgatagactcgagggccagggcggcgtctccggccatgacggaggccaggcgctgttcgaacccgcccgccgggcccttgccgccgccgtcgcgcccgccccgcggggtcttaccctggctggcttcgaaggccgtgaacgtaatgtcggcggggagggcggcgccctcgtggttttcgtcaaacgccaggtgggcggccgcgcgggccacggcgtccacgtttcggcatcgcagtgccacggcggcgggtcccacgaccgcctcgaacaggaggcggttgagggggcggttaaaaaacggaagcgggtaggtaaaattctccccgatcgatcggtggttggcgttgaacggctctgcgatgacacggctaaaatccggcatgaacagctgcaacgggtacacgggtatgcggtgcacctccgccccgcctatggttaccttgtccgagcctcccaggtgcagaaaggtgttgttgatgcacacggcctccttgaagccctcggtaacgaccagatacaggagggcgcggtccgggtccaggccgaggcgctcacacagcgcctcccccgtcgtctcgtgtttgaggtcgccgggccggggggtgtagtccgaaaagccaaaatggcggcgtgcccgctcgcaaagtcgcgtcaggttcggggcctgggtgctggggtccaggtgccggccgccgtgaaagacgtacacggacgagctgtagtgcgagggcgtcagtttcagggacaccgcggtacccccgagccccgtcgtgcgagaacccacgaccacggccacgttggcctcaaagccgctctccacggtcaggcccacgaccaggggcgccacggcgacgtcggaatcgccgctgcgtgccgacagtaacgccagaagctcgatgccttcggacggacacgcgcgagcgtacacgtatcccaggggcccgggggggaccttgatggtggttgccgtcttgggctttgtctccatgtccttttgtcaatcggtccgcgaacggaggtaatcccggcacgacgacggacgcccgacaaggtatgtctcccgagcgtcaaaatccgggggggggcggcgacggtcaaggggagggttggagaccggggttggggaatgaatccctccccttcaccgacaaccccccgggtaaccacggggtgccgatgaaccccggcggccggcaacgcggggtccctgcgagaggcacagatgcttacggtcaggtgctccgggtcgggtgcgtctggtatgcggttggtatatgtacactttacctgggggcgtgccggtccgccccagcccctcccacgccccgcgcgtcatcagccggtgggcgtggccgctattataaaaaaagtgagaacgcgaagcgttcgcactttgtcctaataatatatatattattaggacaaagtgcgaacgcttcgcgttctcactttttttataatagcggccacgcccaccggctacgtcactctcctgtcggccgccggcggtccataagcccggccggccgggccgacgcgaataaaccgggccgccggccggggcgccgcgcagcagctcgccgcccggatccgccagacaaacaaggcccttgcacatgccggcccgggcgagcctgggggtccggtaattttgccatcccacccaagcggctttttgggtttttctcttcccccctccccacattcccctctttaggggttcgggtgggaacaaccgcgatgttttccggtggcggcggcccgctgtcccccggaggaaagtcggcggccagggcggcgtccgggttttttgcgcccgccggccctcgcggagccagccggggacccccgccttgtttgaggcaaaacttttacaacccctacctcgccccagtcgggacgcaacagaagccgaccgggccaacccagcgccatacgtactatagcgaatgcgatgaatttcgattcatcgccccgcgggtgctggacgaggatgcccccccggagaagcgcgccggggtgcacgacggtcacctcaagcgcgcccccaaggtgtactgcgggggggacgagcgcgacgtcctccgcgtcgggtcgggcggcttctggccgcggcgctcgcgcctgtggggcggcgtggaccacgccccggcggggttcaaccccaccgtcaccgtctttcacgtgtacgacatcctggagaacgtggagcacgcgtacggcatgcgcgcggcccagttccacgcgcggtttatggacgccatcacaccgacggggaccgtcatcacgctcctgggcctgactccggaaggccaccgggtggccgttcacgtttacggcacgcggcagtacttttacatgaacaaggaggaggtcgacaggcacctacaatgccgcgccccacgagatctctgcgagcgcatggccgcggccctgcgcgagtccccgggcgcgtcgttccgcggcatctccgcggaccacttcgaggcggaggtggtggagcgcaccgacgtgtactactacgagacgcgccccgctctgttttaccgcgtctacgtccgaagcgggcgcgtgctgtcgtacctgtgcgacaacttctgcccggccatcaagaagtacgagggtggggtcgacgccaccacccggttcatcctggacaaccccgggttcgtcaccttcggctggtaccgtctcaaaccgggccggaacaacacgctagcccagccgcgggccccgatggccttcgggacatccagcgacgtcgagtttaactgtacggcggacaacctggccatcgaggggggcatgagcgacctaccggcatacaagctcatgtgcttcgatatcgaatgcaaggcggggggggaggacgagctggcctttccggtggccgggcacccggaggacctggtcatccagatatcctgtctgctctacgacctgtccaccaccgccctggagcacgtcctcctgttttcgctcggttcctgcgacctccccgaatcccacctgaacgagctggcggccaggggcctgcccacgcccgtggttctggaattcgacagcgaattcgagatgctgttggccttcatgacccttgtgaaacagtacggccccgagttcgtgaccgggtacaacatcatcaacttcgactggcccttcttgctggccaagctgacggacatttacaaggtccccctggacgggtacggccgcatgaacggccggggcgtgtttcgcgtgtgggacataggccagagccacttccagaagcgcagcaagataaaggtgaacggcatggtgaacatcgacatgtacgggattataaccgacaagatcaagctctcgagctacaagctcaacgccgtggccgaagccgtcctgaaggacaagaagaaggacctgagctatcgcgacatccccgcctactacgccgccgggcccgcgcaacgcggggtgatcggcgagtactgcatacaggattccctgctggtgggccagctgttttttaagtttttgccccatctggagctctcggccgtcgcgcgcttggcgggtattaacatcacccgcaccatctacgacggccagcagatccgcgtctttacgtgcctgctgcgcctggccgaccagaagggctttattctgccggacacccaggggcgatttaggggcgccgggggggaggcgcccaagcgtccggccgcagcccgggaggacgaggagcggccagaggaggagggggaggacgaggacgaacgcgaggagggcgggggcgagcgggagccggagggcgcgcgggagaccgccggcaggcacgtggggtaccagggggccagggtccttgaccccacttccgggtttcacgtgaaccccgtggtggtgttcgactttgccagcctgtaccccagcatcatccaggcccacaacctgtgcttcagcacgctctccctgagggccgacgcagtggcgcacctggaggcgggcaaggactacctggagatcgaggtgggggggcgacggctgttcttcgtcaaggctcacgtgcgagagagcctcctcagcatcctcctgcgggactggctcgccatgcgaaagcagatccgctcgcggattccccagagcagccccgaggaggccgtgctcctggacaagcagcaggccgccatcaaggtcgtgtgtaactcggtgtacgggttcacgggagtgcagcacggactcctgccgtgcctgcacgttgccgcgacggtgacgaccatcggccgcgagatgctgctcgcgacccgcgagtacgtccacgcgcgctgggcggccttcgaacagctcctggccgatttcccggaggcggccgacatgcgcgcccccgggccctattccatgcgcatcatctacggggacacggactccatctttgtgctgtgccgcggcctcacggccgccgggctgacggccgtgggcgacaagatggcgagccacatctcgcgcgcgctgtttctgccccccatcaaactcgagtgcgaaaagacgttcaccaagctgctgctgatcgccaagaaaaagtacatcggcgtcatctacgggggtaagatgctcatcaagggcgtggatctggtgcgcaaaaacaactgcgcgtttatcaaccgcacctccagggccctggtcgacctgctgttttacgacgataccgtctccggagcggccgccgcgttagccgagcgccccgcggaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgccccccccgcggccctgccctccccggccaagcgcccccgggagacgccgtcgcctgccgaccccccgggaggcgcgtccaagccccgcaagctgctggtgtccgagctggccgaggatcccgcatacgccattgcccacggcgtcgccctgaacacggactattacttctcccacctgttgggggcggcgtgcgtgacattcaaggccctgtttgggaataacgccaagatcaccgagagtctgttaaaaaggtttattcccgaagtgtggcaccccccggacgacgtggccgcgcggctccggaccgcagggttcggggcggtgggtgccggcgctacggcggaggaaactcgtcgaatgttgcatagagcctttgatactctagcatgagccccccgtcgaagctgatgtccctcattttacaataaatgtctgcggccgacacggtcggaatctccgcgtccgtgggtttctctgcgttgcgccggaccacgagcacaaacgtgctctgccacacgtgggcgacgaaccggtaccccgggcacgcggtgagcatccggtctatgagccggtagtgcaggtgggcggacgtgccgggaaagatgacgtacagcatgtggcccccgtaagtggggtccgggtaaaacaacagccgcgggtcgcacgccccgcctccgcgcaggatcgtgtggacgaaaaaaagctcgggttggccaagaatcccggccaagaggtcctggaggggggcgttgtggcggtcggccaacacgaccaaggaggccaggaaggcgcgatgctcgaatatcgtgttgatctgctgcacgaaggccaggattagggcctcgcggctggtggcggcgaaccgcccgtctcccgcgttgcacgcgggacagcaacccccgatgcctaggtagtagcccatcccggagagggtcaggcagttgtcggccacggtctggtccagacagaagggcagcgagacgggagtggtcttcaccaggggcaccgagagcgagcgcacgatggcgatctcctcggagggcgtctgggcgagggcggcgaaaaggccccgatagcgctggcgctcgtgtaaacacagctcctgtttgcgggcgtgaggcggcaggctcttccgggaggcccgacgcaccacgcccagagtcccgccggccgcagaggagcgcgaccgccggcgctccttgccgtgatagggcccgggccgggagccgcggcgatgggggtcggtgtcatacataggtacacagggtgtgctccagggacaggagcgagatcgagtggcgtctaagcagcgcgcccgcctcacggacaaatgtggcgagcgcggtgggctttggtacaaatacctgatacgtcttgaaggtgtagatgagggcacgcaacgctatgcagacacgcccctcgaactcgttcccgcaggccagcttggccttgtggagcagcagctcgtcgggatgggtggcggggggatggccgaacagaacccaggggtcaacctccatctccgtaatggcgcacatggggtcacagaacatgtgcttaaagatggcctcgggccccgcggcccgaagcaggctcacaaaccggcccccgtccccgggctgcgtctcggggtcagcctcgagctggtcgacgacgggtacgatacagtcgaagaggctcgtgttgttttccgagtagcggaccacggaggcccggagtctgcgcagggccagccagtaagcacgcaccagtaacaggttacacagcaggcattctccgccggtgcgcccgcgcccccggccgtgtttcagcacggtggccatcagagggcccaggtcgaggtcgggctgggcatcgggttcggtaaactgcgcaaagcgcggagccacgtcgcgcgtgcgtgccccgcgatgcgcttcccaggactggcggaccgtggcgcgacgggcctccgcggcagcgcgcagctggggccccgactcccagacggcgggggtgccggcgaggagcaacaggaccagatccgcgtacgcccacgtatccggcgactcctccggctcgcggtccccggcgaccgtctcgaattccccgttgcgagcggcggcgcgagtacagcagctgtccccgcccccgcgccgaccctccgtgcagtccaggagacgggcgcaatccttccagttcatcagcgcggtggtgagcgacggctgcgtgccggatcccgccgccgaccccgccccctcctcgcccccggaggccaaggttccgatgagggcccgggtggcagactgcgccaggaacgagtagttggagtactgcaccttggcggctcccggggagggcgagggcttgggttgcttctgggcatgccgcccgggcaccccgccgtcggtacggaagcagcagtggagaaaaaagtgccggtggatgtcgtttatggtgagggcaaagcgtgcgaaggagccgaccagggtcgccttcttggtgcgcagaaagtggcggtccatgacgtacacaaactcgaacgcggccacgaagatgctagcggcgcagtggggcgcccccaggcatttggcacagagaaacgcgtaatcggccacccactgaggcgagaggcggtaggtttgcttgtacagctcgatggtgcggcagaccagacagggccggtccagcgcgaaggtgtcgatggccgccgcggaaaagggcccggtgtccaaaagcccctccccacagggatccgggggcgggttgcggggtcctccgcgcccgcccgaaccccctccgtcgcccgcccccccgcgggcccttgagggggcggtgaccacgtcggcggcgacgtcctcgtcgagcgtaccgacgggcggcacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtctagacgcgcgctacgtctcgcgagacggcgcgcatgacgcggccgtctggttcgaggatatgacccccgccgagctggaggttgtcttcccgactacggacgccaagctgaactacctgtcgcggacgcagcggctggcctccctcctgacgtacgccgggcctataaaagcgcccgacgacgccgccgccccgcagaccccggacaccgcgtgtgtgcacggcgagctgctcgcccgcaagcgggaaagattcgcggcggtcattaaccggttcctggacctgcaccagattctgcggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataaaaaaggacgcaccgccgccctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccaccaataactctcagtttatcatggataacaaccacccgcacccccagggcacccaaggggccgtgcgggagtttctccgcggtcaggcggcggcgctgacggaccttggtctggcccacgcaaacaacacgtttaccccgcagcctatgttcgcgggcgacgccccggccgcctggttgcggcccgcgtttggcctgcggcgcacctattcaccgtttgtcgttcgagaaccttcgacgcccgggaccccgtgaggcccggggagttccttctggggtgttttaatcaataaaagaccacaccaacgcacgagccttgcgtttaatgtcgtgtttattcaagggagtgggatagggttcgacggttcgaaacttaacacaccaaataatcgagcgcgtctagcccagtaacatgcgcacgtgatgtaggctggtcagcacggcgtcgctgtgatgaagcagcgcccggcgggtccgctgtaactgctgttgtaggcggtaacaggcgcggatcagtaccgccagggcgctacgaccggtgcgttgcacgtagcgtcgcgacagaactgcgtttgccgatacgggcggggggccgaattgtaagcgcgtcacctcttgggagtcatcggcggataacgcactgaatggttcgttggttatgggggagtgtggttccccagggagtgggtcgagcgcctcggcctcggaatccgagaggaacaacgaggtggcgtcggagtcttcgtcgtcagagacatacagggtctgaagcagcgacacgggcgggggggtagcgtcgatgtgtagcgcgagggaggatgcccacgaagacaccccagacaaggagctgcccgtgcgtggatttgtggaagacgcggaagccgggacggatgggcggttttgcggtgcccggaaccgaaccgccggatactccccgggtgctacatgcccgttttggggctggggttggggctggggttggggctggggttggggctggggttggggctggggttggggctggggttggggttggggttggggctggggttggggttggggctggggctggggctggggctggggctggggctggggctggggctggggctggggctggggctggggctggggctggggctggggctggggctggggttggggcgcggacaggcggctgacggtcaaatgcccccgggggcgcgcagatgtggtgggcgtggccaccggctgccgtgtagtggggcggcgggaaaccgggcctccgggcgcaacaccgccctccagcgtcaagtatgtggggggcgggcctgacgtcgggggcggggcgacgggttggaccgcgggaggcgggggagagggacctgcgggagaggatgaggtcggctcggccgggttgcggcctaaaacaggggccgtggggtcggcggggtcccagggtgaagggagggattcccgcgattcggacagcgacgcgacagcggggcgcgtaaggcgccgctgcggcccgcctacgggaaccctggggggggttggcgcgggacccgaggttagcggggggcggcggttttcgcccccgggcaaaaccgtgccggttgcgaccgggggcggaacgggatcgatagggagagcgggagaagcctggccggcggcctggggcccgagcgggaggggcacaccagacaccaaagcgtggggcgctggctctgggggtttgggaggggccggggggcgcgcgaaatcggtaaccggggcgaccgtgtcggggagggcaggcggccgccaaccctgggtggtcgcggaagcctgggtggcgcgcgccagggagcgtgcccggcggtgtcggcgcgcgcgcgacccggacgaagaagcggcagaagcgcgggaggaggcgggggggcggggggcggtggcatcggggggcgccggggaactttggggggacggcaagcgccggaagtcgtcgcgggggcccacgggcgccggccgcgtgctttcggccgggacgcccggtcgtgcttcgcgagccgtgactgccggcccagggggccgcggtgcacactgggacgtggggacggactgatcggcggtgggcgaaagggggtccggggcaaggaggggcgcggggccgccggagtcgtcagacgcgagctcctccaggccgtgaatccatgcccacatgcgaggggggacgggctcgccgggggtggcgtcggtgaatagcgtgggggccaggcttccgggccccaacgagccctccgccccaacaaggtccacagggccgggggtcgggttcgggaccgaggggctctggtcgtcgggggcgcgctggtacaccggatgccccgggaatagctcccccgacaggagggaggcgtcgaacggccgcccgaggatagctcgcgcgaggaaggggtcctcgtcggtggcgctggcggcgaggacgtcctcgccgcccgccacaaacgggagctcctcggtggcctcgctgccaacaaaccgcacgtcgggggggccgggggggtccgggttttcccacaacaccgcgaccggggtcatggagatgtccacgagcaccagacacggcgggccccgggcgaggggccgctcggcgatgagcgcggacaggcgcgggagctgtgccgccagacacgcgttttcgatcgggttcaggtcggcgtgcaggaggcggacggcccacgtctcgatgtcggacgacacggcatcgcgcaaggcggcgtccggcccgcgagcgcgtgagtcaaacagcgtgagacacagctccagctccgactcgcgggaaaaggccgtggtgttgcggagcgccacgacgacgggcgcgcccaggagcactgccgccagcaccaggtccatggccgtaacgcgcgccgcgggggtgcggtgggtggcggcggccggcacggcgacgtgctggcccgtgggccggtagagggcgttggggggagcggggggtgacgcctcgcgcccccccgaggggctcagcgtctgcccagattccagacgcgcggtcagaagggcgtcgaaactgtcatactctgtgtagtcgtccggaaacatgcaggtccaaagagcgaccagagcggtgcttgggagacacatgcgcccgaggacgctcaccgccgccagcgcctgggcgggactcagctttcccagcgcggcgccgcgctcggttcccagctcggggaccgagcgccagggcgccagggggtcggtttcggacaacttgccgcggcgccagtctgccagccgcgtgccgaacatgaggccccgggtcggagggcctccggccgaaaacgctggcagcacgcggatgcgggcgtctggatgcggggtcaggcgctgcacgaatagcatggaatctgctgcgttctgaaacgcacgggggagggtgagatgcatgtactcgtgttggcgaaccagatccaggcgccaaaaggtgtaaatgtgttccggggagctggccaccagcgccaccagcacgtcgttctcgttaaaggaaacgcggtgcctagtggagctctggggtccgagcggcggccccggggccgccgcgtcacccccccattccagctgggcccagcgacacccaaactcgcgcgtgagagtggtcgcgacgagggcgacgtagagctcggccgccgcatccatcgaggccccccatctcgcctggcggtggcgcacaaagcgtccgaagagctgaaagttggcggcctgggcgtcgctgagggccagctgaagccggttgatgacggtgaggacgtacatggccgtgacggtcgaggccgactccagggtgtccgtcggaagcggggggcgaatgcatgccgcctcgggacacatcagcagcgcgccgagcttgtcggtcacggccgggaagcagagcgcgtactgcagtggcgttccatccgggaccaaaaagctgggggcgaacggccgatccagcgtactggtggcctcgcgcagcaccaggggccccgggcctccgctcactcgcaggtacgcctcgccccggcggcgcagcatctgcgggtcggcctcttggccgggtggggcggacgcccgggcgcgggcgtctagggcgcgaagatccacgagcaggggcgcgggcgcggccgccgcgcccgcgcccgtctggcctgtggccttggcgtacgcgctatataagcccatgcggcgttggatgagctcccgcgcgccccggaactcctccaccgcccatggggccaggtccccggccaccgcgtcgaattccgccaacaggccccccagggtgtcaaagttcatctcccaggccacccttggcaccacctcgtcccgcagccgggcgctcaggtcggcgtgttgggccacgcgccccccgagctcctccacggccccggcccgctcggcgctcttggcgcccaggacgccctggtacttggcgggaaggcgctcgtagtcccgctgggctcgcagccccgacacagtgttggtggtgtcctgcagggcgcgaagctgctcgcatgccgcgcgaaatccctcgggcgatttccaggcccccccgcgaacgcggccgaagcgaccccatacctcgtcccactccgcctcggcctcctcgagagacctccgcagggcctcgacgcggcgacgggtgtcgaagagcgcctgcaggcgcgcgccctgtcgcgtcaggaggcccgggccgtcgccgctggccgcgcttagcgggtgcgtctcaaaggtacgctgggcatgttccaaccaggcgaccgcctgcacgtcgagctcgcgcgccttctccgtctggtccaccagaatttcgacctgatccgcgatctcctccgccgagcgcgcctggtccagcgtcttggccacggtcgccgggacggcgaccaccttcagcagggtcttcagattggccagaccctcggcctcgagctgggcccggcgctcgcgcgcggccagcacctcccgcagccccgccgtgacccgctcggtggcttcggcgcgctgctgtttggcgcgcaccacggcgtccttggtatcggccaggtcctgtcgggtcacgaatgcgacgtagtcggcgtacgccgtgtccttcacggggctctggtccacgcgctccagcgccgccacgcacgccaccagcgcgtcctcgctcgggcagggcagggtgacccctgcccggacaagctcggcggccgccgccgggtcgttgcgcaccgcggatatctcctccgcggcggcggccaggtccagcgccacgcttccgatcgcgcgccgcgcgtcggcccggagggcgtccaggcgatcgcggatatccacgtactcggcgtagcccttttgaaaaaacggcacgtactggcgcagggccggcacgccccccaagtcttccgacaggtgtaggacggcctcgtggtagtcgataaacccgtcgttcgcctgggcccgctccagcagcccccccgccagccgcagaagccgcgccaggggctcggtgtccacccgaaacatgtcggcgtacgtgtcggccgcggccccgaaggccgcgctccagtcgatgcggtgaatggctgcgagcggggggagcatggggtggcgctggttctcgggggtgtatgggttaaacgcaagggccgtctccagggcaagggtcaccgccttggcgttggttcccagcgcctgttcggcccgctttcggaagtcccgggggttgtagccgtgcgtgcccgccagcgcctgcaggcgacggagctcgaccacgtcaaactcggcaccgctttccacgcggtccagcacggcctccacgtcggcggcccagcgctcgtggctactgcgggcgcgctgggccgccatcttctctctgaggtcggcggtggcggcctcaagttcgtcggcgcggcgtcgcgtggcgccgatgacctttcccagctcctgcagggcgcgcccgctgggggagtggtccccggccgtcccttcggcgtgcaacaggcccccgaacctgccctcgtggcccgcgaggctttcccgcgcgccggtggtcgcgcgcgtcgcggcctggatcagggaggcatgctctccctccggttggttggcggcccggcgcacctggacgacaaggtcggcggcagccgaccctaaggtcgtgagctgggcgatggccacccgcgcgtccagggccaaccgagtcgccttgacgtatcccgcggcgctgtcggccatggccgctaggaaggccaggggggaggccgggtcgctggcggccgcgcccagggccgtcaccgcgtcgaccaggacgcggtgcgcccgcacggccgcatccaccgtcgacgcagggtctgccgttgcgacggcggcgctgccggcgttgatggcgttcgagacggcgtgggctatgatcggggcgtgatcggcgaagaactgcaagagaaacggagtctctggggcgtcggcgaacaggttcttcagcaccaccacgaagctgggatgcaagccagacagagccgtcgccgtgtccggagtcgggtgctccagggcatctcggtactgccccagcagcccccacatgtccgcccgcagcgccgccgtaacctcagggggcgccccccgaacggcctcggggaggtccgaccagcccgccggcagggaggcccgcagggtcgccaggacggccggacaggcctttagccccacaaagtcagggagggggcgcaggaccccctggagtttgtgcaagaacttctcccgggcgtcgcgggccaccttcgcccgctcccgcgctccctcgagcattgcctccagggagcgcgcgcgctcccgcaaacgggcacgcgcatcgggggcgagctctgccgtcagcttggcggcatccatggcccgcgcctgccgcagcgcttcctcggccatgcgcgtggcctctggcgacagcccgccgtcgtcggggtagggcgacgcgccgggcgcaggaacaaaggccgcgtcgctgtccagctgctggcccagggccgcatctagggcgtcgaagcgccgcagctcggccagacccgagctgcggcgcgcctgttggtcgttaatgtcgcggatgctgcgcgccagctcgtccagtggcttgcgttctatcagcccttggttggcggcgtccgtcaggacggagagccaggccgccaggtcctcgggggcgtccagcgtctggccccgctggatcagatcccgcaacaggatggccgtggggctggtcgcgatcgggggcggggcgggaatggcggcgcgctgcgcgatgtcccgcgtgtgctggtcgaagacaggcagggactcgagcagctggaccacgggcacgacggcggccgaagccacgtgaaaccggcggtcgttgttgtcgctggcctgtagagccttggcgctgtatacggccccccggtaaaagtactccttaaccgcgccctcgatcgcccgacgggcctgggtccgcacctcctccagccgaacctgaacggcctcggggcccagggggggtgggcgcggagccccctgcggggccgccccggccggggcgggcattacgccgaggggcccggcgtgctgtgagaccgcgtcgaccccgcgagcgagggcgtcgagggcctcgcgcatctggcgatcctccgcctccaccctaatctcttcgccacgggcaaatttggccagagcctggactctatacagaagcggttctgggtgcgtcggggtggcgggggcaaaaagggtgtccgggtgggcctgcgagcgctccagaagccactcgccgaggcgtgtatacagattggccggcggggccgcgcgaagctgcagctccaggtccgcgagttccccgtaaaaggcgtccgtctcccgaatgacatccctagccacaaggatcagcttcgccagcgccaggcgaccgatcagagagttttcgtccagcacgtgctggacgaggggcagatgggcggccacgtcggccaggctcaggcgcgtggaggccagaaagtcccccacggccgttttccagggcagcatgttcagggtaaactccagcagggcggcggccgggccggccaccccggcctgggtgtgcgtccgggccccgttctcgatgagaaaggcgaggacgcgttcaaagaaaaaaataacacagagctccagcagccccggagaggccggatacggcgaccgtaaggcgctgatggtgagccgcgaacacgcggcgacctcgcgggccagggcggcggagcacgcggtgaacttaaccgccgtggcggccacgtttgggtgggcctcgaacagctgggcgaggtctgcgcccgggggctcgggcgagcggcgagtcttcagcgcctcgagggcctgtgaggacgccggaaccgtgggcccgtcgtcctcgcccgcctcggcgaccggcggcccggccgggtcggggggtgccgaggcgaggacaggctccggaacggaggcggggaccgcggccccgacgggggttttgcctttgggggtggatttcttcttggttttggcagggggggccgagcgtttcgttttctcccccgaagtcaggtcttcgacgctggaaggcggagtccaggtgggtcggcggcgcttgggaaggccggccgagtagcgtgcccggtgccgaccaaccgggacgacgcccatctccaggacccgcatgtcgtcgtcatcttcttcggccgcctctgcggcgggggtcttgggggcggagggaggcggtggtgggatcgcggagggtgggtcggcggagggtgggtcggcggaggggggatccgtgggtggggtacccttcagggccaccgcccatacatcgtcgggcgcccgattcgggcgcttggcctctggttttgccgacggaccggccgtcccccgggatgtctcggaggccctgtcgtcgcgacgggcccgggtcggtggcggcgactgggcggctgtgggcgggtgtggccccgggccccctaccccctcccgggggcccacgccgacgcagggctcccccaggcccgcgatctcgccccgcagggggtgcgtgatggccacgcgccgttcgctgaacgcttcgtcctgcaggtaagtctcgctggccccgtaaagatgcagagccgcggccgtcaagtccgcaggagccgcgggttccgggcccgacggcacgaaaaacaccatggctcccgcccaccgtacgtccgggcgatcgcgggtgtaatacgtcaggtatggatacatgtcccccgcccgcactttggcgatgaacgcgggggtgccctccggaaggccgtgcgggtcaaaaaggtatgcggtgtcgccgtccctgaacagccccatccctagggggccaatggttaggagcgtgtacgacagggggcgcagggcccacgggccggcgaagaacgtgtgtgcggggcattgtgtctccagcaggcccgccgcgggctccccgaagaagcccacctcgccgtatacgcgcgagaagacacagcgcagtccgccgcgcgcccctgggtactcgaggaagttggggagctcgacgatcgaacacatgcgcggcggcccagggcccgcggtcgcgcgcgtccactcgcccccctcgaccaaacatccctcgatggcctccgcggacaggacgtcgcgagggcccacatcaaatatgaggctgagaaaggacagcgacgagcgcatgcacgataccgacccccccggctccaggtcgggcgcgaactggttccgagcaccggtgaccacgatgtcgcgatcccccccgcgttccatcgtggagtgcggtggggtgcccgcgatcatatgtgccctgctggccagagacccggcctgtttatggaccggacccccggggttagtgttgtttccgccacccatgcccccgtaccatggccccggttcccctgattaggctacgagtcgcggtgatcgcttcccaaaaaccgagctgcgtttgtctgtcttggtcttccacccccccccccgcccgcccgcacaccataacaccgagaacaacacacgggggtgggcgtaacataataaagctttattggtaactagttaacggcaagtccgtgggtggcgcgacggtgtcctccgggatcatctcgtcgtcctcgacgggggtgttggaatgaggcgccccctcgcggtccgcctggcgtgggccgtgcccataggcctccggcttctgtgcgtccatgggcataggcgcggggagactgtttccggcgtcgcggacctccaggtccctgggagactccggtccggctaacggacgaaacgcggaagcgcgaaacacgccgtcggtgacccgcaggagctcgttcatcagtaaccaatccatactcagcgtaacggccagcccctggcgagacagatccacggagtccggaaccgcggtcgtctggcccagggggccgaggctgtagtccccccaggcccctaggtcgcgacggctcgtaagcacgacgcggtcggccgcggggctttgcgggggggcgtcctcgggcgcatgcgccattacctctcggatggccgcggcgcgctggtcggccgagctgaccaagggcgccacgaccacggcgcgctccgtctgcaggcccttccacgtgtcgtggagttcctggacaaactcggccacgggctcgggtcccgcggccgcgcgcgcggcttgatagcaggccgacagacgccgccagcgcgctagaaactgacccatgaagcaaaacccggggacctggtctcccgacagcagcttcgacgcccgggcgtgaatgccggacacgacggacagaaacccgtgaatttcgcgccggaccacggccagcacgttgtcctcgtgcgacacctgggccgccagctcgtcgcacacccccaggtgcgccgtggtttcggtgatgacggaacgcaggctcgcgagggacgcgaccagcgcgcgcttggcgtcgtgatacatgctgcagtactgactcaccgcgtcccccatggcctcggggggccagggccccaggcggtcgggcgtgtccccgaccaccgcatacaggcggcgcccgtcgctctcgaaccgacactcgaaaaaggcggagagcgtgcgcatgtgcagccgcagcagcacgatggcgtcctccagttggcgaatcagggggtctgcgcgctcggcgaggtcctgcagcaccccccgggcggccagggcgtacatgctaatcaacaggaggctggtgcccacctcggggggcggggggggctgcagctggaccaggggccgcagctgctcgacggcacccctggagatcacgtacagctcccggagcagctgctctatgttgtcggccatctgcatagtggggccgaggccgccccgggcggccggttcgaggagggtgatcagcgcgcccagtttggtgcgatggccctcaaccgtggggagatagcccagcccaaagtcccgggcccaggccaacacacgcagggcgaactcgaccgggcggggaaggtaggccgcgctacacgtggccctcagcgcgtccccgaccaccagggccagaacgtaggggacgaagcccgggtcggcgaggacgttggggtgaatgccctcgagggcggggaagcggatctgggtcgccgcggccaggtggacagagggggcgtggctgggctgcccgacggggagaagcgcggacagcggcgtggccggggtggtgggggtgatgtcccagtgggtctgaccatacacgtcgatccagatgagcgccgtctcgcggagaaggctgggttgaccggaactaaagcggcgctcggccgtctcaaactcccccacgagcgcccgccgcaggctcgccagatgttccgtcggcacggccggacccatgatacgcgccagcgtctggcttagaacgccccccgacaggccgaccgcctcgcagagccgcccgtgcgtgtgctcgctggcgccctggacccgcctgaaagtttttacgtagttggcatagtacccgtattcccgcgccaacccaaacacgttcgaccccgcgagggcaatgcacccaaagagctgctggacttcgccgagtccgtggccggtgggcgtccgcgcggggacgcccgccgccagaaacccctccagggccgaaaggtagtgcgtgcagtgcgagggcgtgaacccagcgtcgatcagggtgttgatcaccacggagggcgaattggtattctggatcaacgtccacgtctgctgcagcagagccagcagccgctgctgggcgccggcggagggctgctccccgagctgcagcaggctggagacggcaggctggaagactgccagtgccgacgaactcaggaacggcacgtcgggatcaaacacggccacgtccgtccgcacgcgcgccattagcgtccccgggggcgcacaggccgagcgcgggctgacgcggctgagggccgtcgacacgcgcacctcctcgcggctgcgaaccatcttgttggcctcgagcggcggaatcattatggccgggtcgatctcccgcacggtgtgctgaaactgcgccaacaggggcggcgggaccacagccccccgctcgggggtcgtcaggtactcgtccaccagggccaacgtaaagagggcccgtgtgaggggagtgagggtcgcgtcgtctatgcgctggaggtgcgccgagaacagcgtcacccgattactcaccagggccaagaaccggaggccctcttgcacgaacggggcggggaagagcaggctgtacgccggggtggtaaggttcgcgctgggctgccccaacgggaccggcgccatcttgagcgacgtctccccaagggcctcgatggaggtccgcgggctcatggccaagcagctcttggtgacggtttgccagcggtctatccactccacggcgcactggcggacgcggaccggccccagggccgccgcggtgcgcaggccggcggaatccagcgcatgggacgtgtcggagccggtgaccgcgaggatggtgtccttgatgacctccatctcccggaaggcctggtcgggggcctcggggagagccaccaccaagcggtgtacgagcaacccggggaggttctcggccaagagcgccgtctccggaagcccgtgggcccggtggagcgcgcacaggtgttccagcagcggccgccagcatgcccgcgcgtctgccggggcgatggccgttcccgacaacagaaacgccgccatggcggcgcgcagcttggccgtggccagaaacgccgggtcgtccgccccgtttgccgtctcggccgtgggggttggcggttggcgaaggccggctaggctcgccaataggcgctgcataggtccgtccgagggcggaccggcgggtgaggtcgtgacgacgggggcctcggacgggagaccgcggtctgccatgacgcccggctcgcgtgggtgggggacagcgtagaccaacgacgagaccgggcgggaatgactgtcgtgcgctgtagggagcggcgaattatcgatcccccgcggccctccaggacccccgcaggcgttgcgagtaccccgcgtcttcgcggggtgttatacggccacttaagtcccggcatcccgttcgcggacccaggcccgggggattgtccggatgtgcgggcagcccggacggcgtgggttgcggactttctgcggggcggcccaaatggccctttaaacgtgtgtatacggacgcgccgggccagtcggccaacacaacccaccggaggcggtagccgcgtttggctgtggggtgggtggttccgccttgcgtgagtgtcctttcgacccccccccccctccctcccccgggtcttgctaggtcgcgatctggggtcgcaatgaagaccaatccgctacccgcaaccccttccgtgtggggcgggagtaccgtggaactcccccccacaacacgcgataccgcgggacagggcctgcttcggcgcgtcctgcgccccccgatctctcgccgcgacggcccagggctccccagggggtcgggaccccggagggcggccagcacgctgtggttgcttggcctggacggcacagacgcgccccctggggcgctgacccccaacgacgataccgaacaggccctggacaagatcctgcggggcaccatgcgcgggggggcggccctgatcggctccccgcgccatcatctaacccgccaagtgatcctgacggatctgtgccaacccaacgcggatcgtgctgggacgctgcttctggcgctgcggcaccccgccgacctgcctcacctggcccaccagcgcgccccgccaggccggcagaccgagcggctgggcgaggcctggggccagctgatggaggcgaccgccctggggtcggggcgagccgagagcgggtgcacgcgcgcgggcctagtgtcgtttaacttcctggtggcggcgtgtgccgcctcgtacgacgcgcgcgacgccgccgatgcggtacgggcccacgtcacggccaactaccgcgggacgcgggtgggggcgcgcctggatcgtttttccgagtgtctgcgcgccatggttcacacgcacgtcttcccccacgaggtcatgcggtttttcggggggctggtgtcgtgggtcacccaggacgagctagcgagcgtcaccgccgtgtgcgccgggccccaggaggcggcgcacaccggccacccgggccggccccgctcggccgtgatcctcccggcatgtgcgttcgtggacctggacgccgagctggggctggggggcccgggcgcggcgtttctgtacctggtattcacttaccgccagcgccgggaccaggagctgtgttgtgtgtacgtgatcaagagccagctccccccgcgcgggttggagccggccctggagcggctgtttgggcgcctccggatcaccaacacgattcacggcaccgaggacatgacgcccccggccccaaaccgaaaccccgacttccccctcgcgggcctggccgccaatccccaaaccccgcgttgctcggctggccaggtcacgaacccccagttcgccgacaggctgtaccgctggcagccggacctgcgggggcgccccaccgcacgcacctgtacgtacgccgcctttgcagagctcggcatgatgcccgaggatagtccccgctgcctgcaccgcaccgagcgctttggggcggtcagcgtccccgttgtcattctggaaggcgtggtgtggcgccccggcgagtggcgggcatgcgcgtgagcgtagcaaacgccccgcccacacaacgctccgcccccaaccccttccccgctgtcactcgttgttcgttgacccgggcgtccgccaaataaagccactgaaacccgaaacgcgagtgttgtaacgtcctttgggcgggaggaagccacaaaatgcaaatgggatacatggaaggaacacacccccgtgactcaggacatcggtgtgtccttttgggtttcactgaaactggcccgcgccccacccctgcgcgatgtggataaaaagccagcgcgggtggtttagggtaccacaggtgggtgctttggaaacttgccggtcgccgtgctcctgtgagcttgcgtccctccccggtttcctttgcgctcccgccttccggacctgctctcgcctatcttctttggctctcggtgcgattcgtcaggcagcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccagggggaggccgccggggcccctctcgcccacggccaccacgtgtactgccagcgagtcaatggcgtgatggtgctttccgacaagacgcccgggtccgcgtcctaccgcatcagcgatagcaactttgtccaatgtggttccaactgcaccatgatcatcgacggagacgtggtgcgcgggcgcccccaggacccgggggccgcggcatcccccgctcccttcgttgcggtgacaaacatcggagccggcagcgacggcgggaccgccgtcgtggcattcgggggaaccccacgtcgctcggcggggacgtctaccggtacccagacggccgacgtccccaccgaggcccttgggggcccccctcctcctccccgcttcaccctgggtggcggctgttgttcctgtcgcgacacacggcgccgctctgcggtattcgggggggagggggatccagtcggccccgcggagttcgtctcggacgaccggtcgtccgattccgactcggatgactcggaggacacggactcggagacgctgtcacacgcctcctcggacgtgtccggcggggccacgtacgacgacgcccttgactccgattcgtcatcggatgactccctgcagatagatggccccgtgtgtcgcccgtggagcaatgacaccgcgcccctggatgtttgccccgggacccccggcccgggcgccgacgccggtggtccctcagcggtagacccacacgcgccgacgccagaggccggcgctggtcttgcggccgatcccgccgtggcccgggacgacgcggaggggctttcggacccccggccacgtctgggaacgggcacggcctaccccgtccccctggaactcacgcccgagaacgcggaggccgtggcgcgctttctgggagatgccgtgaaccgcgaacccgcgctcatgctggagtacttttgccggtgcgcccgcgaggaaaccaagcgtgtcccccccaggacattcggcagcccccctcgcctcacggaggacgactttgggcttctcaactacgcgctcgtggagatgcagcgcctgtgtctggacgttcctccggtcccgccgaacgcatacatgccctattatctcagggagtatgtgacgcggctggtcaacgggttcaagccgctggtgagccggtccgctcgcctttaccgcatcctgggggttctggtgcacctgcggatccggacccgggaggcctcctttgaggagtggctgcgatccaaggaagtggccctggattttggcctgacggaaaggcttcgcgagcacgaagcccagctggtgatcctggcccaggctctggaccattacgactgtctgatccacagcacaccgcacacgctggtcgagcgggggctgcaatcggccctgaagtatgaggagttttacctaaagcgttttggcgggcactacatggagtccgtcttccagatgtacacccgcatcgccggctttttggcctgccgggccacgcgcggcatgcgccacatcgccctggggcgagaggggtcgtggtgggaaatgttcaagttctttttccaccgcctctacgaccaccagatcgtaccgtcgacccccgccatgctgaacctggggacccgcaactactacacctccagctgctacctggtaaacccccaggccaccacaaacaaggcgaccctgcgggccatcaccagcaacgtcagtgccatcctcgcccgcaacgggggcatcgggctatgcgtgcaggcgtttaacgactccggccccgggaccgccagcgtcatgcccgccctcaaggtccttgactcgctggtggcggcgcacaacaaagagagcgcgcgtccgaccggcgcgtgcgtgtacctggagccgtggcacaccgacgtgcgggccgtgctccggatgaagggggtcctcgccggcgaagaggcccagcgctgcgacaatatcttcagcgccctctggatgccagacctgtttttcaagcgcctgattcgccacctggacggcgagaagaacgtcacatggaccctgttcgaccgggacaccagcatgtcgctcgccgactttcacggggaggagttcgagaagctctaccagcacctcgaggtcatggggttcggcgagcagatacccatccaggagctggcctatggcattgtgcgcagtgcggccacgaccgggagccccttcgtcatgttcaaagacgcggtgaaccgccactacatctacgacacccagggggcggccatcgccggctccaacctctgcaccgagatcgtccatccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggaatcggcatgcagggcctgcacacggcctgcctgaagctggggctggatctggagtctgccgaatttcaggacctgaacaaacacatcgccgaggtgatgctgctgtcggcgatgaagaccagcaacgcgctgtgcgttcgcggggcccgtcccttcaaccactttaagcgcagcatgtatcgcgccggccgctttcactgggagcgctttccggacgcccggccgcggtacgagggcgagtgggagatgctacgccagagcatgatgaaacacggcctgcgcaacagccagtttgtcgcgctgatgcccaccgccgcctcggcgcagatctcggacgtcagcgagggctttgcccccctgttcaccaacctgttcagcaaggtgacccgggacggcgagacgctgcgccccaacacgctcctgctaaaggaactggaacgcacgtttagcgggaagcgcctcctggaggtgatggacagtctcgacgccaagcagtggtccgtggcgcaggcgctcccgtgcctggagcccacccaccccctccggcgattcaagaccgcgtttgactacgaccagaagttgctgatcgacctgtgtgcggaccgcgccccctacgtcgaccatagccaatccatgaccctgtatgtcacggagaaggcggacgggaccctcccagcctccaccctggtccgccttctggtccacgcatataagcgcggactaaaaacagggatgtactactgcaaggttcgcaaggcgaccaacagcggggtctttggcggcgacgacaacattgtctgcatgagctgcgcgctgtgaccgacaaaccccctccgcgccaggcccgccgccactgtcgtcgccgtcccacgctctcccctgctgccatggattccgcggccccagccctctcccccgctctgacggcccttacgggccagagcgcgacggcggacctggcgatccagattccaaagtgccccgaccccgagaggtacttctacacctcccagtgtcccgacattaaccacctgcgctccctcagcatccttaaccgctggctggaaaccgagcttgttttcgtgggggacgaggaggacgtctccaagctttccgagggcgagctcagcttttaccgcttcctcttcgctttcctgtcggccgccgacgacctggttacggaaaacctgggcggcctctccggcctgtttgagcagaaggacattctccactactacgtggagcaggaatgcatcgaagtcgtacactcgcgcgtgtacaacatcatccagctggtgcttttccacaacaacgaccaggcgcgccgcgagtacgtggccggtaccatcaaccacccggccatccgcgccaaggtggactggttggaagcgcgggtgcgggaatgcgcctccgttccggaaaagttcattctcatgatcctcatcgagggcatcttttttgccgcctcgtttgccgccatcgcctaccttcgcaccaacaaccttctgcgggtcacctgccagtcaaacgacctcatcagccgggacgaggccgtgcacacgacggcctcgtgttacatctacaacaactacctcggcgggcacgccaagcccccgcccgaccgcgtgtacgggctgttccgccaggcggtcgagatcgagatcggatttatccgatcccaggcgccgacggacagccatatcctgagcccggcggcgctggcggccatcgaaaactacgtgcgattcagcgcggatcgcctgttgggccttatccacatgaagccactgttttccgccccaccccccgacgccagctttccgctgagcctcatgtccaccgacaaacacaccaattttttcgagtgtcgcagcacctcctacgccggggcggtcgtcaacgatctgtgagtgtcgcggcgcgcttctacccgtgtttgcccataataaacctctgaaccaaactttgggtctcattgtgattcttgtcagggacgcgggggtgggagaggataaaaggcggcgcaaaaagcagtaaccaggtccgtccagattctgcgggcataggataccataattttattggtgggtcgtttgttcggggacaagcgcgctcgtctgacgtttgggctactcgtcccagaatttggccaggacgtccttgtagaacgcgggtgggggggcctgggtccgcaactgctccagaaacctgtcggcgatatcaggggccgtgatatgccgggtcacgatagatcgcgccaggttttcgtcgcggatgtcctggtagataggcaggcgtttcagaagagtccacggcccccgctccttggggccgataagcgatatgacgtacttaatgtagcggtgttccaccagctcggtgatggtcatgggatcggggagccagtccagggactctggggcgtcgtggatgacgtggcgtcgccggttggccacataactgcggtgctcttccagcagctgcgcgttcgggacctggacgagctcgggcggggtgagtatctccgaggaggacgacctggggccggggtggcccccggtaacgtcccggggatccagggggaggtcctcgtcgtcttcgtatccgccggcgatctgttgggttagaatttcggtccacgagacgcgcgtctcggtgccgccggcggccggcggcagagggggcctggtttccgtggagcgcgagctggtgtgttcccggcggatggcccgccgggtctgagagcgactcgggggggtccagtgacattcgcgcagcacatcctccacggaggcgtaggtgttattgggatggaggtcggtgtggcagcggacaaagagggccaggaactgggggtagctcatcttaaagtactttagtatatcgcgacagttgatcgtgggaatgtagcaggcgctaatatccaacacaatatcacagcccatcaacaggaggtcagtgtccgtggtgtacacgtacgcgaccgtgttggtgtgatagaggttggcgcaggcatcgtccgcctccagctgacccgagttaatgtaggcgtaccccagggcccggagaacgcgaatacagaacagatgcgccagacgcagggccggcttcgagggcgcggcggacggcagcgcggctccggacccggccgtcccccgggtccccgaggccagagaggtgccgcgccggcgcatgttggaaaaggcagagctgggtctggagtcggtgatgggggaaggcggtggagaggcgtccacgtcactggcctcctcgtccgtccggcactgggccgtcgtgcgggccaggatggccttggctccaaacacaaccggctccatacaattgaccccgcgatcggtaacgaagatggggaaaagggacttttgggtaaacacctttaataagcgacagaggcagtgtagcgtaatggcctcgcggtcgtaactggggtatcggcgctgatatttgaccaccaacgtgtacatgacgttccacaggtccacggcaatgggggtgaagtacccggccggggccccaaggccccggcgcttgaccagatggtgtgtgtgggcaaacttcatcatcccgaacaaacccatgtcaggtcaattgtaactgcggatcggcctaactaaggcgtggttggtgcgacggtccgggacacccgagcctgtctctctgtgtatggtgacccagacaacaacaccgacacaagaggacaataatccgttaggggacgctctttataatttcgatggcccaactccacgcggattggtgcagcaccctgcatgcgccggtgcgggccaaccttccccccgctcattgcctcttccaaaagggtgtggcctaacgagctgggggcgtatttaatcaggctagcgcggcgggcctgccgtagtttctggctcggtgagcgacggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctgacggggcggggccttggcggccgcccaactctcgcaccatcccgggttaatgtaaataaacttggtattgcccaacactttcccgcgtgtcgcgtgtggttcatgtgtgtgcctggcgcccccaccctcgggttcgtgtatttcctttccctgtccttataaaagccgtatgtggggcgctgacggaaccaccccgcgtgccatcacggccaaggcgcgggatgctccgcaacgacagccaccgggccgtgtccccggaggacggccagggacgggtcgacgacggacggccacacctcgcgtgcgtgggggccctggcgcgggggttcatgcatatctggcttcaggccgccacgctgggttttgcgggatcggtcgttatgtcgcgcgggccgtacgcgaatgccgcgtctggggcgttcgccgtcgggtgcgccgtgctgggctttatgcgcgcaccccctcccctcgcgcggcccaccgcgcggatatacgcctggctcaaactggcggccggtggagcggcccttgttctgtggagtctcggggagcccggcacgcagccgggggccccggccccgggcccggccacccagtgcctggcgctgggcgccgcctatgcggcgctcctggtgctcgccgatgacgtctatccgctctttctcctcgccccggggcccctgttcgtcggcaccctggggatggtcgtcggcgggctgacgatcggaggcagcgcgcgctactggtggatcggtgggcccgccgcggccgccctggccgcggcggtgttggcgggcccgggggcgaccaccgccagggactgcttttccagggcttgccccgaccaccgccgcgtctgtgtcatcaccgcaggcgagtctctttcccgccgccccccggaggacccagagcgacccggggttcccgggcccccgtcccccccgaccccccaacgatcccacgggccgccggccgatgaggtcgcaccggccagggtcgcgcggcccgaaaacgtctgggtgcccgtggtcacctttctgggggcgggcgcgcttgccgtcaagacggtgcgagaacatgcccggggaacgccgggcccgggcctgccgctgtggccccaggtgtttctcggaggccatgtggcggtggccctgacggagctgtgtcaggcgcttgcgccctgggaccttacggacccgctgctgtttgttcacgccggactgcaggtcatcaacctcgggttggtgtttcggttttccgaggttgtcgtgtatgcggcgctagggggtgccgtgtggatttcgttggcgcaggtgctggggctccggcgtcgcctgcacaggaaggaccccggggacggggcccggttggcggcgacgcttcggggcctcttcttctccgtgtacgcgctggggtttggggtgggggtgctgctgtgccctccggggtcaacgggcgggcggtcgggcgattgatatatttttcaataaaaggcattagtcccgaagaccgccggtgtgtgatgatttcgccataacacccaaaccccggatggggcccgggtataaattccggaaggggacacgggctaccctcactatcgagggcgcttggtcgggaggccgcatcgaacgcacacccccatccggtggtccgtgtggaggtcgttttcagtgcccggtctcgctttgccgggaacgctagccgatccctcgcgagggggaggcgtcgggcatggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcaccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccggcatgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaacgcaagacccccccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctgggttggcgtcgggaccatcatcgggggagttgtgatcattgccgcgttggtcctcgtgccctcgcgggcctcgtgggcactttccccatgcgacagcggatggcacgagttcaacctcgggtgcatatcctgggatccgacccccatggagcacgagcaggcggtcggcggctgtagcgccccggcgaccctgatcccccgcgcggctgccaaacagctggccgccgtcgcacgcgtccagtcggcaagatcctcgggctactggtgggtgagcggagacggcattcgggcctgcctgcggctcgtcgacggcgtcggcggtattgaccagttttgcgaggagcccgcccttcgcatatgctactatccccgcagtcccgggggctttgttcagtttgtaacttcgacccgcaacgcgctggggctgccgtgaggcgcgtgtactgcggtctgtctcgtctcctcttctccccttccctccccctccgcatcccaggatcacaccggtcaacgagggttgggggggtccggcacggacccaaaataataaacacacaatcacgtgcgataaaaagaacacgcggtcccctgtggtgtttttggttatttttattaaatctcgtcgacaaacagggggaaaggggcgtggtctagcgacggcagcacgggcggaggcgttcaccggctccggcgtccttcgcgtttaagcttggtcaggagggcgctcagggcggcgacgttggtcgggccgtcgttggtcagggcgttggctcgatggcgggcgaggacgggcgaggggctcaacggcgggggcgggggcccggtgcggcccgggggggaaaatagggcggatcccccccagtcgtacaggggattttccgcctcaatgtacggggaggccggcgctgcattcgccgtgttcacgcagacgttttcgtagacccgcatccatggtatttcctcgtagacacgccccccgtcctcgctcaccgtctcgtatattgactcgtcgtcctcgtagggggcgtgccgttcgcgggccgaggcggcgtgggtggctttgcggcgggcgtcgtcgtcgtcgtcgtcggccgtcagatacgtggcttccatctggtcgggttctccctccggggcgggtccccacacccgtggccgatcgaggctccccagagacgcgcgccggacgaggagggggcacgtcgccgccggcggtcgcctgtcgggtcccgcgacgttacgggccgggaggcgcgggggcacctcccccatgtgcgtgtaatacgtggccggctgtgtggccgcagcggggggctcggcgaccgggtcgttcgcatccggaagcgggggccccgcgccgtccgcgcggcgcctccggaacctccgggtggacgcgggggtcgagtgtaggcgaggtcgggggaggggcgggggctcgttgtcgcgccgcgcccgctgaatcttttcccgacaggtcccaccccccgcgcgatgcccccccgggccgctggccatgtcgtccgggggaggccccgcggaccacgtcgtccggcgagacgccacgagccgcaggatggactcgtagtggagcgacggcgccccgttgcggagcagatccgcggccagggcggccccgaaccaagccttgatgctcaactccatccgggcccagctgggggcggtcatcgtggggaacaggggggcggtggtccgacagaaacgctcctggctgtccaccgcggcccgcagatactcgttgttcaggctgtcggtggcccagacgccgtacccggtgagggtcgcgttgatgatatactgggcgtggtgatggacgatcgacagaacctccaccgtggatacgacggtatccacggtcccgtacgtaccgccgctccgcttgccggtctgccacaggttggctaggcgcgtcaggtggcccaggacgtcgctgaccgccgccctgagcgccatgcactgcatggagccggtcgtgccgctgggaccccggtccagatggcgcgcgaacgtttccgcgggcgcctccgggctgccgccgagcgggaggaaccggcgattggagggactcagccggtgacatacgtgcttgtccgtcgtccacagcatccaggacgcccaccggtacagcacggagacgtaggccaggagctcgttgagccgcagtgcggtgtcggtgctggggcggcttgggtccgccgggcgcataaagaacatgtactgctgaatccgatggagggcgtcgcgcaggccggccacggtggcggcgtacttggccgccacggccccgctcttgaacggggtgcgcgccagcagctttggcgccagggtgggccgcagcagcacgtgaaggctggggtcgcagtcgcccacggggtcctcggggacgtccaggccgctgggcaccaccgtctgcaggtacttccagtactgcgtgaggatggcgcggctcaactggccgccgggcagctccacctcgcccagcgcctgggtggcggccgaagcgtagtgccggatgtactcgtagtgcgggtcgctggcgagcccgtccacgatcaaactctcgggaaccgtgttgtgttgccgcgcggccaaccggacgctgcgatcggtgcaggtcagaaacgccggctgcgcgtcgtcggagcgctgccgcaaggcgcccacggccgcgctaaggagcccctccggggtggggagcagacacccgccgaagatgcgccgctcgggaacgcccgcgttgtcgccgcggatcaggttggcaggcgtcaggcaccgcgccagccgcagggagctcgcgccgcgcgtccggcgctgcatggtgacgcccgttcggtcgggacccgccggtcggagttatgccgcgtccagggccatcggggcgctttttatcgggaggagcttatgggcgtggcgggcctcccagcccggtcgcgcgcctccccgacacgtgcgcccgcagggcggcggccccctcgtctcccatcagcagtttcctaaactgggacatgatgtccaccacgcggacccgcgggcccaacacggacccgccgcttacgggggcgggggggaagggctccaggtccttgagaagaaaggcggggtctgccgtcccggacacgggggcccggggcgctgaggaggcggggcgcagatccacgtgctccgcggccgcgcggacgtccgcccagaacttggcgggggtggtgcgcgcgtacaggggctgggtcgctcggaggacgcacgcgtagcgcaggggggtgtacgtgcccacctcgggggccgtgaatcccccgtcaaacgcggccagtgtcacgcacgccaccacggtgtcggcaaagcccagcagccgctgcaggacgagcccggcggccagaatggcgcgcgtggccgccgcgtcgtcccggcgccggtgcgcgtccccgcacgcccgggcgtactttaaggtcacggtcgccagggccgtgtgcagcgcgtacaccgcagcgcccagcacggcgttgagcccgctgttggcgagcagccggcgcgctgcggtgtcgcccagcgcctcgtgctcggcccccacgaccgcggggcttcccaggggcagggcgcgaaacagctcctcccgcgccacgtccgcaaaggcggggtggtgcacgtgcgggtgcaggcgcgcccccacgaccaccgagagccactggaccgtctgctccgccatcaccgccagcacatccagcacgcgccccaggaaggcggcctcccgcgtcaaaacgcaccggacggcgtcgggattgaagcgggcgagcagggccccggtggccaggtacgtcatgcggccggcatagcgggcggccacgcgacagtcgcggtccagcagcgcgcgcaccccgggccagtacagcagggaccccagcgagctgcggaacaccgcggcgtcggggccggattggggggacactaacccccccgcgctcagtaacggcacggccgcggccccgacgggacgcaacgccgtgaggctcgcgaactgccgcctcagctcggccgccctgtcgtccaggtcagacccgcgcgcctccgcgtgaaggcgcgtcccgcacacccacccgttgatggccagccgcacgacggcatccgccaaaaagctcatcgcctgggcggggctggtttttgttcgacgatccgtcaggtcaagaatcccatcgcccgtgatataccaggccaacgcctcgccctgctgcagggtttggcggaaaaacaccgcggggttgtcgggggaggcgaagtgcatgacccccacgcgcgataacccgaacgcgctatccggacacgggtaaaacccggccggatgccccagggctagggcggagcgcacggactcgtcccacacggcaacctgaggggccagtcgatccaacgggaatgccgcccggagctccgggcccggcacgcgtccctccagaacctccaccttgggcggggaacgggccccgccgccgtcctccggcccgacggcttccgggtagtcgtcctcctcgtactgcagctcctctaggaacagcggcgacggcgccacccgcgaaccgccgacccgccccaaaatagcccgcgcgtcgacgggacccaggtatcccccctgccgggcctgcggaggaccgcggggaacctcatcatcatcgtccaggcgaccgcgcaccgactggctacgggccgcatcgggcccggggcgctgccgggacgctcggcgatgggatgtgggcggggcttccgacgcgcgccgtcgtcgggctcgcgggccttcccgtcgacggcgcacgggcggctcgtcgcccgccatctcctccagagcctctagctcgctgtcgtcatccccgcggaacaccgcacgcaggtaccccatgaaccccaccccatcgcccgctggctcgtccgccacgggcgaggcgcgggggcgggtggatgcgcgcctcctgcgccccgcgggttcgcgagccgacatggtggcgatagacgcgggttatcggatgtccgctaccccccaaaaaagaaaaagaccccacagcgcggatggaggccggggtaggtgccgccggaccccctcgcgatgggaatggacgggagcgacggggccggcgcaaaaaaacgcagtatctcccgcgaaggctacccgccgccccagcccccggccaaatgcggaaacggtcccgcgctctcgcctttatacgcgggccgccctgcgacacaatcacccgtccgtggtttcgaatctacacgacaggcccgcagacgcggctaacacacacgccggcaacccagaccccagtgggttggttgcgcggtcccgtctcctggctagttctttcccccaccaccaaataatcagacgacaaccgcaggttttgtaatgtatgtgctcgtgtttattgtggatacgaaccggtgacgggaggggaaaacccagacgggggatgcgggtccggtcgcgccccctacccaccgtactcgtcaattccaagggcatcggtaaacatctgctcaaactcgaagtcggccatatccagagcgccgtagggggcggagtcgtggggggtaaatcccggccccggggaatccccgtcccccaacatgtccagatcgaaatcgtctagcgcgtcggcatgcgccatcgccacgtcctcgccgtctaagtggagctcgtcccccaggctgacatcggtcgggggggccgtcgacagtctgcgcgtgtgtcccgcggggagaaaggacaggcgcggagccgccagccccgcctcttcgggggcgtcgtcgtccgggagatcgagcaggccctcgatggtagacccgtaattgtttttcgtacgcgcgcggctgtacgcgtgttcccgcatgaccgcctcggagggcgaggtcgtgaagctggaatacgagtccaacttcgcccgaatcaacaccataaagtacccagaggcgcgggcctggttgccatgcagggtgggaggggtcgtcaacggcgcccctggctcctccgtagccgcgctgcgcaccagcgggaggttaaggtgctcgcgaatgtggtttagctcccgcagccggcgggcctcgattggcactccccggacggtgagcgctccgttgacgaacatgaagggctggaacagacccgccaactgacgccagctctccaggtcgcaacagaggcagtcaaacaggtcgggccgcatcatctgctcggcgtacgcggcccataggatctcgcgggtcaaaaatagatacaaatgcaaaaacaaaacacgcgccagacgagcggtctctcggtagtacctgtccgcgatcgtggcgcgcagcatttctcccaggtcgcgatcgcgtccgcgcatgtgcgcctggcggtgcagctgccggacgctggcgcgcaggtaccggtacagggccgagcagaagttggccaacacggttcgatagctctcctcccgcgcccgtagctcggcgtggaagaaacgagagagcgcttcgtagtagagcccgaggccgtcgcgggtggccggaagcgtagggaaggccacgtcgccgtgggcgcgaatgtcgatttgggtgcgttcggggacgtacgcgtccccccattccaccacatcgctgggcagcgttgataggaatttacactcccggtacaggtcggcgttggtcggtagcgccgaaaacagatcctcgttccaggtatcgagcatggtacatagcgcggggcccgcgctaaagcccaagtcgtcgaggagacggttaaagagggcggcgggggggacgggcatgggtggggagggcatgagctgggcctggctcaggcgccccgttgcgtacagcgggggggccgccggggtgtttttgggacccccggccgggcgggggggcggtggcgaagcgccgtccgcgttcatgtcggcaaacagctcgtcgaccaagaggtccattgggtggggttgatacgggaaagacgatatcgggcttttgatgcgatcgtccccgcccgcccagagagtgtgggacgcccgacggcgcgggaagagaaaacccccaaacgcgttagaggaccggacggaccttatggggggaagtgggcagcgggaaccccgtccgttcccgaggaatgacagcccgtggtcgccaccacgcatttaagcaacccgcacgggccgccccgtacctcgtgacttccccccacattggctcctgtcacgtgaaggcgaaccgagggcggctgtccaacccaccccccgccacccagtcccggtccccgtcggattgggaaacaaaggcacgcaacgccaacaccgaatgaacccctgttggtgctttattgtctgggtacggaagttttcactcgacgggccgtctggggcgagaagcggagcgggctggggctcgaggtcgctcggtggggcgcgacgccgcagaacgccctcgagtcgccgtggccgcgtcgacgtcctgcaccacgtctggattcaccaactcgttggcgcgctgaagcaggtttttgccctcgcagaccgtcacgcggatggtggtgatgccaaggagttcgttgaggtcttcgtctgtgcgcggacgcgacatgtcccagagctggaccgccgccatccgggcatgcatggccgccaggcgcccgaccgcggcgcagaagacgcgcttgttaaagccggccacccggggggtccatggcgcgtcggggtttgggggggcggtgctaaagtgcagctttctggccagcccctgcgcgggtgtcttggatcgggttggcgccgtcgacgcgggggcgtctgggagtgcggcggattctggctgggccgatttcctgccgcgggtggtctccgccgccggggccgcgggggccttagtcgccacccgctgggttcggggggcccggggggcggtggtgggtgtgcgtccggcccctccggacccagcgggtggcggaggcgcccgcgcaggccccgggccggacaaaaccgccccggaaacgggacgccgcgtccgggggacctccgggtgttcgtcgtcttcggatgacgagcccccgtagagggcataatccgactcgtcgtactggacgaaacggacctcgcccctctggcgcgagcgtgtctgtagggcgccacggcgggaggtgtcaggcggactatcgggactcgccatacctgaagacggggtgtagtacagatcctcgtactcatcgcgcggaacctcccgcggacccgacttcacggagcggcgagaggtcatggttccacgaacacgctagggtcggatgcgcggacaattaggcctgggttcggacggcgggggtggtgcaggtgtggagaggtcgagcgataggggcggcccgggagagaagagagggtccgcaaaacccactggggatgcgtgagtggccctctgtgggcggtgggggagagtcttataggaagtgcatataaccacaacccatgggtctaaccaatccccaggggccaagaaacagacacgccccaaacggtctcggtttccgcgaggaaggggaagtcctgggacaccctccacccccacccctcaccccacacagggcgggttcaggcgtgcccggcagccagtagcctctggcagatctgacagacgtgtgcgataatacacacgcccatcgaggccatgcctacataaaagggcaccagggcccccggggcagacatttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagatgagtcagtggggatccggggcgatccttgtccagccggacagcttgggtcgggggtacgatggcgactggcacacggccgtcgctactcgcgggggcggagtcgtgcaactgaacctggtcaacaggcgcgcggtggcttttatgccgaaggttagcggggactccggatgggccgtcgggcgcgtctctctggacctgcgaatggctatgccggctgacttttgcgcgattattcacgcccccgcgctagccagccccgggcaccacgtaatactgggtcttatcgactcggggtaccgcggaaccgttatggccgtggtcgtagcgcctaaaaggacgcgggaatttgcccccgggaccctgcgggtcgacgtgacgttcctggacatcctggcgacccccccggccctcaccgagccgatttccctgcggcagttcccgcaactggcgcccccccctccaaccggggccgggatacgcgaagatccttggttggagggggcgctcggggccccaagcgtgactacggccctaccggcgcgacgccgagggcggtccctcgtctatgccggcgagctgacgccggttcagacggaacacggggacggcgtacgagaagccatcgccttccttccaaaacgcgaggaggatgccggtttcgacattgtcgtccgtcgcccggtcaccgtcccggcaaacggcaccacggtcgtgcagccatccctccgcatgctccacgcggacgccgggcccgcggcctgctatgtgttggggcggtcgtcgctcaacgcccgcggcctcctggtcgttcctacgcgctggctccccgggcacgtatgtgcgtttgttgtttacaaccttacgggggttcctgtgaccctcgaggccggcgccaaggtcgcccagctcctggttgcgggggcggacgctcttccttggatccccccggacaactttcacgggaccaaagcgcttcgaaactaccccaggggtgttccggactcaaccgccgaacccaggaacccgccgctcctggtgtttacgaacgagtttgacgcggaggcccccccgagcgagcgcgggaccgggggttttggctctaccggtatttagcccacagctttgggttcgttccgggcaataaaaaacgtttgtatcgcatctttcctgtgtgtagttgtttatgttggatgcctgtgggtctatcacacccgcccctccatcccacaaacacaaaacacacgggttggatgaaaacacgcatttattgacccaaaacacacggagctgctcgagatgggccagggcgaggtgcggttggggaggctgtaggtctgggaacggacacgcggggacacgattccggtttggggtccgggagggcgtcgccgtttcgggcggcaggcgccagcgtaacctccgggggcggcgtgtgggggtgccccaaggagggcgcctcggtcaccccaatcccccccgaccgggttcccccggcaaccccgaaggcggagaggccaagggcccgttcggcgatggccacatcctccatgaccacgtcactctcggccatgctccgaatagcctgggagacgagcacatccgcggacttgtcagccgcccccacggacatgtacatctgcaggatggtggccatacacgtgtccgccaggcgccgcatcttgtcctgatgggccgccacggccccgtcgatcgtgggggcctcgagcccggggtggtggcgcgccagtcgttctaggttcaccatgcaggcgtggtacgtgcgggccaaggcgcgggccttcacgaggcgtcgggtgtcgtccagggaccccagggcgtcatcgagcgtgatgggggcgggaagtagcgcgttaacgaccgccagggcctcctgcagccgcggctccgcctccgagggcggaacggccgcgcggatcatctcatattgttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgcgttattacctcttcgatcgccctcctcacaaactctctactgggggccgagccggtttatatattcagctacgacgcatacacgcacgatggccgtgccgacgggcccacggagcaagacaggttcgaagagagtcgggcgctctaccaagcgtcgggcgggctaaatggcgactccttccgagtaaccttttgtttattggggacggaagtgggtgggacccaccaggcccgcgggcgaacccgacccatgttcgtctgtcgcttcgagcgagcggacgacgtcgccgcgctacaggacgccctggcgcacgggaccccgctacaaccggaccacatcgccgccaccctggacgcggaggccacgttcgcgctgcatgcgaacatgatcctggctctcaccgtggccatcaacaacgccagcccccgcaccggacgcgacgccgccgcggcgcagtatgatcagggcgcgtccctacgctcgctcgtggggcgcacgtccctgggacaacgcggccttaccacgctatacgtccaccacgaggtgcgcgtgcttgccgcgtaccgcagggcgtattatggaagcgcgcagagtcccttctggtttcttagcaaattcgggccggacgaaaaaagcctggtgctcaccactcggtactacctgcttcaggcccagcgtctggggggcgcgggggccacgtacgacctgcaggccatcaaggacatctgcgccacctacgcgattccccacgccccccgccccgacaccgtcagcgctgcgtccctgacctcgtttgccgccatcacgcggttctgttgcacgagccagtacgcccgcggggccgcggcggccgggtttccgctttacgtggagcgccgtattgcggccgacgtccgcgagaccagtgcgctggagaagttcataacccacgatcgcagttgcctgcgcgtgtccgaccgtgaattcattacgtacatctacctggcccattttgagtgtttcagccccccgcgcctagccacgcatcttcgggccgtgacgacccacgaccccaaccccgcggccagcacggagcagccctcgcccctgggcagggaggccgtggaacaatttttttgtcacgtgcgcgcccaactgaatatcggggagtacgtcaaacacaacgtgaccccccgggagaccgtcctggatggcgatacggccaaggcctacctgcgcgctcgcacgtacgcgcccggggccctgacgcccgcccccgcgtattgcggggccgtggactccgccaccaaaatgatggggcgtttggcggacgccgaaaagctcctggtcccccgcgggtggcccgcgtttgcgcccgccagtcccggggaggacacggcgggcggcacgccgcccccacagacctgcggaattgtcaagcgcctcctgagactggccgccacggaacagcagggccccacacccccggcgatcgcggcgcttatccgtaatgcggcggtgcagactcccctgcccgtctaccggatatccatggtccccacgggacaggcatttgccgcgctggcctgggacgactgggcccgcataacgcgggacgctcgcctggccgaagcggtcgtgtccgccgaagcggcggcgcaccccgaccacggcgcgctgggcaggcggctcacggatcgcatccgcgcccagggccccgtgatgccccctggcggcctggatgccggggggcagatgtacgtgaatcgcaacgagatattcaacggcgcgctggcaatcacaaacatcatcctggatctcgacatcgccctgaaggagcccgtcccctttcgccggctccacgaggccctgggccactttaggcgcggggctctggctgcggttcagctcctgtttcccgcggcccgcgtggaccccgacgcatatccctgttattttttcaaaagcgcatgtcggcccggcccggcgtccgtgggttccggcagcggactcggcaacgacgacgacggggactggtttccctgctacgacgacgccggtgatgaggagtgggcggaggacccgggcgccatggacacatcccacgatcccccggacgacgaggttgcctactttgacctgtgccacgaagtcggccccacggcggaacctcgcgaaacggattcgcccgtgtgttcctgcaccgacaagatcggactgcgggtgtgcatgcccgtccccgccccgtacgtcgtccacggttctctaacgatgcggggggtggcacgggtcatccagcaggcggtgctgttggaccgagattttgtggaggccatcgggagctacgtaaaaaacttcctgttgatcgatacgggggtgtacgcccacggccacagcctgcgcttgccgtattttgccaaaatcgcccccgacgggcctgcgtgcggaaggctgctgccagtgtttgtgatcccccccgcctgcaaagacgttccggcgtttgtcgccgcgcacgccgacccgcggcgcttccattttcacgccccgcccacctatctcgcttccccccgggagatccgtgtcctgcacagcctgggtggggactatgtgagcttctttgaaaggaaggcgtcccgcaacgcgctggaacactttgggcgacgcgagaccctgacggaggtcctgggtcggtacaacgtacagccggatgcgggggggaccgtcgaggggttcgcatcggaactgctggggcggatagtcgcgtgcatcgaaacccactttcccgaacacgccggcgaatatcaggccgtatccgtccggcgggccgtcagtaaggacgactgggtcctcctacagctagtccccgttcgcggtaccctgcagcaaagcctgtcgtgtctgcgctttaagcacggccgggcgagtcgcgccacggcgcggacattcgtcgcgctgagcgtcggggccaacaaccgcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttcggtgccagtccgctgcaccgatgtatttacgcggtacgccccaccggcaccaacaacgacaccgccctcgtgtggatgaaaatgaaccagaccctattgtttctgggggccccgacgcacccccccaacgggggctggcgcaaccacgcccatatctgctacgccaatcttatcgcgggtagggtcgtgcccttccaggtcccacctgacgccatgaatcgtcggatcatgaacgtccacgaggcagttaactgtctggagaccctatggtacacacgggtgcgtctggtggtcgtagggtggttcctgtatctggcgttcgtcgccctccaccaacgccgatgtatgtttggcgtcgtgagtcccgcccacaagatggtggccccggccacctacctcttgaactacgcaggccgcatcgtatcgagcgtgttcctgcagtacccctacacgaaaattacccgcctgctctgcgagctgtcggtccagcggcaaaacctggttcagttgtttgagacggacccggtcaccttcttgtaccaccgccccgccatcggggtcatcgtaggctgcgagttgatgctacgctttgtggccgtgggtctcatcgtcggcaccgctttcatatcccggggggcatgtgcgatcacataccccctgtttctgaccatcaccacctggtgttttgtctccaccatcggcctgacagagctgtattgtattctgcggcggggcccggcccccaagaacgcagacaaggccgccgccccggggcgatccaaggggctgtcgggcgtctgcgggcgctgctgttccatcatcctctcgggcatcgcagtgcgattgtgttatatcgccgtggtggccggggtggtgctcgtggcgcttcactacgagcaggagatccagaggcgcctgtttgatgtatgacgtcacatccaggccggcggaaaccgtaacggcatatgcaaattggaaactgtcctgtcttggggcccacccacccgacgcgtcatatgcaaatgaaaatcggtcccccgaggccacgtgtagcctggatcccaacgaccccgcccatgggtcccaattggccgtcccgttaccaagaccaacccagccagcgtatccacccccgcccgggtccccgcggaagcggaacggggtatgtgatatgctaattaaatacatgccacgtacttatggtgtctgattggtccttgtctgtgccggaggtggggcgggggccccgcccggggggcggaacgaggaggggtttgggagagccggccccggcaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagcccggtcatggcgactgacattgatatgctaattgacctcggcctggacctctccgacagcgatctggacgaggacccccccgagccggcggagagccgccgcgacgacctggaatcggacagcagcggggagtgttcctcgtcggacgaggacatggaagacccccacggagaggacggaccggagccgatactcgacgccgctcgcccggcggtccgcccgtctcgtccagaagaccccggcgtacccagcacccagacgcctcgtccgacggagcggcagggccccaacgatcctcaaccagcgccccacagtgtgtggtcgcgcctcggggcccggcgaccgtcttgctcccccgagcagcacgggggcaaggtggcccgcctccaacccccaccgaccaaagcccagcctgcccgcggcggacgccgtgggcgtcgcaggggtcggggtcgcggtggtcccggggctgccgatggtttgtcggacccccgccggcgtgcccccagaaccaatcgcaaccctgggggaccccgccccggggcggggtggacggacggccccggcgccccccatggcgaggcgtggcgcggcagtgagcagcccgacccacccggaggccagcggacacggggcgtgcgccaagcaccccccccgctaatgacgctggcgattgcccccccgcccgcggacccccgcgccccggccccggagcgaaaggcgcccgccgccgacaccatcgacgccaccacgcggttggtcctgcgctccatctccgagcgcgcggcggtcgaccgcatcagcgagagctttggccgcagcgcacaggtcatgcacgacccctttggggggcagccgtttcccgccgcgaatagcccctgggccccggtgctggcgggccaaggagggccctttgacgccgagaccagacgggtctcctgggaaaccttggtcgcccacggcccgagcctctatcgcacttttgccggcaatcctcgggccgcatcgaccgccaaggccatgcgcgactgcgtgctgcgccaagaaaatttcatcgaggcgctggcctccgccgacgagacgctggcgtggtgcaagatgtgcatccaccacaacctgccgctgcgcccccaggaccccattatcgggacggccgcggctgtgctggataacctcgccacgcgcctgcggccctttctccagtgctacctgaaggcgcgaggcctgtgcggcctggacgaactgtgttcgcggcggcgtctggcggacattaaggacattgcatccttcgtgtttgtcattctggccaggctcgccaaccgcgtcgagcgtggcgtcgcggagatcgactacgcgacccttggtgtcggggtcggagagaagatgcatttctacctccccggggcctgcatggcgggcctgatcgaaatcctagacacgcaccgccaggagtgttcgagtcgtgtctgcgagttgacggccagtcacatcgtcgcccccccgtacgtgcacggcaaatatttttattgcaactccctgttttaggtacaataaaaacaaaacatttcaaacaaatcgcccctcgtgttgtccttctttgctcatggccggcggggcgtgggtcacggcagatggcgggggtgggcccggcgtacggcctgggtgggcggagggaactaacccaacgtataaatccgtccccgttccaaggccggtgtcatagtgcccttaggagcttcccgcccgggcgcatccccccttttgcactatgacagcgacccccctcaccaacctgttcttacgggccccggacataacccacgtggcccccccttactgcctcaacgccacctggcaggccgaaacggccatgcacaccagcaaaacggactccgcttgcgtggccgtgcggagttacctggtccgcgcctcctgtgagaccagcggcacaatccactgctttttctttgcggtatacaaggacacccaccacacccctccgctgattaccgagctccgcaactttgcggacctggttaaccacccgccggtcctacgcgaactggaggataagcgcggggtgcggctgcggtgtgcgcggccgtttagcgtcgggacgattaaggacgtctctgggtccggcgcgtcctcggcgggagagtacacgataaacgggatcgtgtaccactgccactgtcggtatccgttctcaaaaacatgctggatgggggcctccgcggccctacagcacctgcgctccatcagctccagcggcatggccgcccgcgcggcagagcatcgacgcgtcaagattaaaattaaggcgtgatctccaacccccccatgaatgtgtgtaaccccccccaaaaaaataaagagccgtaacccaaccaaaccaggcgtggtgtgagtttgtggacccaaagccctcagagacaacgcgacaggccagtatggaccgtgatacttttatttattaactcacaggggcgcttaccgccacaggaataccagaataatgaccaccacaatcgcgaccaccccaaatacagcatggcgccacaccacgccacaacagccctgtcgccggtatggggcatgatcagacgagccgcgcgccgcgcgttgggccctgtacagctcgcgcgaattgaccctaggaggccgccacgcgcccgagttttgcgttcgtcgctggtcgtcgggcgccaaagccccggacggctgttcggtcgaacgaacggccacgacagtggcataggttggggggtggtccgacatagcctcggcgtacgtcgggaggcccgacaagaggtcccttgtgatgtcgggtggggccacaagcctggtttccggaagaaacaggggggttgccaataacccgccagggccaaaactccggcgctgcgcacgtcgttcggcgcggcgccgggcgcgccgagcggctcgctgggcggcttggcgtgagcggccccgctccgacgcctcgccctctccggaggaggttggcggaattggcacggacaacaggggcccagcagagtacggtggaggtgggtccgtgggggtgtccagatcaataacgacaaacggcccctcgttcctaccagacaagctatcgtaggggggcgggggatcagcaaacgcgttccccgcgctccataaacccgcgtcgggttgcgccgcctccgaagccatggatgcgccccaaagccacgactcccgcgcgctaggtccttggggtaatggaaaaggccctactccccatccaagccagccaagttaacgggctacgccttcgggaatgggactggcaccccggcggattttgttgggctggcatgcgtcgcccaaccgagggccgcgtccacgggacgcgccttttataaccccgggggtcattcccaacgatcacatgcaatctaactggctcccctctccccccctctcccctctccccccctctcccctctccccccctctcccctctccccccctctcccctctccccccctctcccctctccccccctctcccctctccccccctctcccctctccccccctctcccctctccccccctctcccctctccccccctctcccctctcccctctgctctttccccgtgacacccgacgctgggggcgtggctgccgggaggggccgcggatgggcgggcctacttggtctcccgccccccccccccccccccgaaccgccccgccggctttgcccccctttgatcccctgctacccccaacccgtgctggtggtgcgggttggggggggatgtgggcgggggtgcgcgggaggtgtcggtggtggtggtggtggtggtagtaggaatggtggtgagggggggggggcgctggttggtcaaaaaagggagggacgggggccggcagaccgacggcgacaacgctccccggcggccgggtcgcggctcttacgagcggcccggcccgcgctcccaccccccgggccgtgtccttgctttccccccgtctcccccccccccgccttctcctcctcctcctcgtttttccaaaccccgcccacccggcccggcccggcccggcccggcccggccaccgccgcccacccacccacctcgggatacccagccccggtcccccgttccccgggggccgttatctccagcgccccgtccggcgcgccgccccccgccgctaaaccccatcccgcccccgggaccccacatataagcccccagccacacgcaagaacagacacgcagaacggctgtgtttatttaaataaaccaatgtcggaataaacaaacacaaacacccgcgacggggggacggaggggacggagggagggggtgacgggggacgggaacagacacaaaaacaaccacaaaaaacaaccacccaccgacacccccaccccagtctcctcgccttctcccacccaccccacgcccccactgagcccggtcgatcgacgagcacccccgcccacgcccccgcccctgccccggcgacccccggcccgcacgatcccgacaacaataacaaccccaacggaaagcggcggggtgttgggggaggcgaggaacaaccgaggggaacgggggatggaaggacgggaagtggaagtcctgatacccatcctacacccccctgccttccaccctccggccccccgcgagtccacccgccggccggctaccgagaccgaacacggcggccgccgcagccgccgcagccgccgccgacaccgcagagccggcgcgcgcactcacaagcggcagaggcagaaaggcccagagtcattgtttatgtggccgcgggccagcagacggcccgcgacaccccccccccgcccgtgtgggtatccggccccccgccccgcgccggtccattaagggcgcgcgtgcccgcgagatatcaatccgttaagtgctctgcagacaggggcaccgcgcccggaaatccattaggccgcagacgaggaaaataaaattacatcacctacccacgtggtgctgtggcctgtttttgctgcgtcatctcagcctttataaaagcgggggcgcggccgtgccgatcgcgggtggtgcgaaagactttccgggcgcgtccgggtgccgcggctctccgggcccccctgcagccggggcggccaaggggcgtcggcgacatcctccccctaagcgccggccggccgctggtctgttttttcgttttccccgtttcgggggtggtgggggttgcggtttctgtttctttaacccgtctggggtgtttttcgttccgtcgccggaatgtttcgttcgtctgtcccctcacggggcgaaggccgcgtacggcccgggacgaggggcccccgaccgcggcggtccgggccccgtccggacccgctcgccggcacgcgacgcgaaaaaggccccccggaggcttttccgggttcccggcccggggcctgagatgaacactcggggttaccgccaacggccggcccccgtggcggcccggcccggggccccggcggacccaaggggccccggcccggggccccacaacggcccggcgcatgcgctgtggtttttttttcctcggtgttctgccgggctccatcgcctttcctgttctcgcttctccccccccccttcttcacccccagtaccctcctccctcccttcctcccccgttatcccactcgtcgagggcgccccggtgtcgttcaacaaagacgccgcgtttccaggtaggttagacacctgcttctccccaatagaggggggggacccaaacgacagggggcgccccagaggctaaggtcggccacgccactcgcgggtgggctcgtgttacagcacaccagcccgttcttttccccccctcccacccttagtcagactctgttacttacccgtccgaccaccaactgcccccttatctaagggccggctggaagaccgccagggggtcggccggtgtcgctgtaaccccccacgccaatgacccacgtactccaagaaggcatgtgtcccaccccgcctgtgtttttgtgcctggctctctatgcttgggtcttactgcctggggggggggagtgcgggggagggggggtgtggaaggaaatgcacggcgcgtgtgtaccccccctaaagttgttcctaaagcgaggatacggaggagtggcgggtgccgggggaccggggtgatctctggcacgcgggggtgggaagggtcgggggagggggggatggagtaccggcccacctggccggcgcgggtgcgcgtgcctttgcacaccaaccccacgtcccccggcggtctctaagaagcaccgccccccctccttcataccaccgagcatgcctgggtgtgggttggtaaccaacacgcccatcccctcgtctcctgtgattctctggctgcaccgcattcttgttttctaactatgttcctgtttctgtctcccccccccccacccctccgccccaccccccaacacccacgtctgtggtgtggccgacccccttttgggcgccccgtcccgccccgccacccctcccatcctttgttgccctatagtgtagttaaccccccccgccctttgtggcggccagaggccaggtcagtccgggcgggcaggcgctcgcggaaacttaacacccacacccaacccactgtggttctggctccatgccagtggcaggatgctttcggggatcggtggtcaggcagcccgggccgcggctctgtggttaacaccagagcctgcccaacatggcacccccactcccacgcacccccactcccacgcacccccactcccacgcacccccactcccacgcacccccactcccacgcacccccactcccacgcacccccactcccacgcacccccactcccacgcacccccactcccacgcatccccgcgatacatccaacacagacagggaaaagatacaaaagtaaacctttatttcccaacagacagcaaaaatcccctgagtttttttttattagggccaacacaaaagacccgctggtgtgtggtgcccgtgtctttcacttttcccctccccgacacggattggctggtgtagtgggcgcggccagagaccacccagcgcccgacccccccctccccacaaacacggggggcgtcccttattgttttccctcgtcccgggtcgacgccccctgctccccggaccacgggtgccgagaccgcaggctgcggaagtccagggcgcccactagggtgccctggtcgaacagcatgttccccacgggggtcatccagaggctgttccactccgacgcgggggccgtcgggtactcggggggcatcacgtggttacccgcggtctcggggagcagggtgcggcggctccagccggggaccgcggcccgcagccgggtcgccatgtttcccgtctggtccaccaggaccacgtacgccccgatgttccccgtctccatgtccaggatgggcaggcagtcccccgtgatagtcttgttcacgtaaggcgacagggcgaccacgctagagacccccgagatgggcaggtagcgcgtgaggccgcccgcggggacggccccggaagtctccgcgtggcgcgtcttccgggcacacttcctcggcccccgcggcccagaagcagcgcgggggccgagggaggtttcctcttgtctccctcccagggcaccgacggccccgcccgaggaggcggaagcggaggaggacgcggccccggcggcggaagaggcggcccccgcgggggtcggggccgaggaggaagaggcagaggaggaagaggcggaggccgccgaggacgtcaggggggtcccgggcccaccctggccgcgcccccccggccctgagtcggagggggggtgcgtcgccgccctcttggcccctgccggcgcgagggggggacgcgtggactggggggaggggttttcctggcccgacccgcgcctcttcctcggacgcaccgccgcctcctgctcgacagaggcggcggaggggagcggggcggcgccggagggggcggcgccgcgggagggcccgtgcccaccctccacgcccggcccccccgagccgcgcgccaccgtcgcacgcgcccggcacagactctgttcttggttcgcggcctgagccagggacgagtgcgactggggcacacggcgcgcgtccgcggggcgggcggccggctccgccccgggggccggggcgcgggggccgggccccggaggcggcgctcgcacgcacggggccacggccgcgcgggggcgcgcgggtcccgacgcggccgcggacgcggggggcccggggcggggggcggagcctggcatgggcgccgcggggggcctgtggggagaggccgggggggagtcgctgatcactatggggtctctgttgtttgcaaggggggcgggtctgttgacaagggggcccgtccggcccctcggccgccccgcctccgcttcaacaaccccaaccccaaccccaacccccccggaggggccagacgccccccgcggcgccgcggctcgcgactggcgggagccgccgccgccgctgctgttggtggtggtgttggtgttactgctgccgtgtggcccgatgggcgccgaggggggcgctgtccgagccgcggccggctggggggctgcgtgagacgccccgcccgtcacggggggcgcggcggcgcctctgcgtgggggggcgcggggcgtccggcggggggcgggcggtacgtagtctgctgcaagagacaacggggggcgcgatcaggttacgccccctccccggcccgccctttcctcgcccgcccgcctattcctccctccccccccctcctcctcctcctcccccagggtccttgccgccccccgcctcacaaaataatgctttatttgtgaaatttgtgatgctattgctttatttcactcctggactggctcccagcagtcaaaggggatgacaagcagaaagtccttcaggttctctttgaaactttcaaaggtgataatctgggttgcacaggaagtttccggggttggagggcagtgctgcttgtagtggctggccatcatggtcaaggggcccttgagcttggtgaggctgccccgcaggccctgcttgtacagctccaggcgggtctgtaggcaggtcggctcctggaggtcaaacatttctgagatgacttctactgtttcattcatctcagcagcagtgtctctactcaggttcaggagacgccgggcctcctggatggcattcacatgctcccagggctgcgtgctggggctgggcgagcgggcgggtgcagagatgctgcaggccacagtgcccaagagcagcaggctctgcagccacatcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactgggggtcgtatgcggctggagggtcgcggacggagggtccctgggggtcgcaacgtaggcggggcttctgtggtgatgcggagagggggcggcccgagtctgcctggctgctgcgtctcgctccgagtgccgaggtgcaaatgcgaccagactgtcgggccagggctaacttataccccacgcctttcccctccccaaaggggcggcagtgacgattcccccaatggccgcgcgtcccaggggaggcaggcccaccgcggggcggccccgtccccggggaccaacccggcgcccccaaagaatatcattagcatgcacggcccggcccccgatttgggggcccaacccggtgtcccccaaagaaccccattagcatgcccctcccgccgacgcaacaggggcttggcctgcgtcggtgccccggggcttcccgccttcccgaagaaactcattaccatacccggaaccccaggggaccaatgcgggttcattgagcgacccgcgggccaatgcgcgaggggccgtgtgttccgccaaaaaagcaattagcataacccggaaccccaggggagtggttacgcgcggcgcgggaggcggggaataccggggttgcccattaagggccgcgggaattgccggaagcgggaagggcggccggggccgcccattaatgagtttctaattaccataccgggaagcggaacaaggcctcttgcaagtttttaattaccataccgggaagtgggcggcccggcccattgggcggtaactcccgcccaatgggccgggccccgaagactcggcggacgctggttggccgggccccgccgcgctggcggccgccgattggccagtcccgcccccgaggcgggcccgccctgtgagggcgggctggctccaagcgtatatatgcgcggctcctgccatcgtctctccggagagcggcttggtgcggagctcccgggagctccgcggaagacccaggccgcctcgggtgtaacgttagaccgagttcgccgggccggctccgcgggccagggcccgggcacgggcctcgggccccaggcacggcccgatgaccgcctcggcctccgccacccggcgccggaaccgagcccggtcggcccgctcgcgggcccacgagccgcggcgcgccaggcgggcggccgaggcccagaccaccaggtggcgcacccggacgtggggcgagaagcgcacccgcgcgggggtcgcgggggtcgcgggggtcgcgggggtcgcgggggtcgcggggggctccggcgccccctccccgcccgcgcgtcgcaggcgcaggcgcgccaggtgctccgcggtgacgcgcaggcggagggcgaggcgcggcggaaggcggaaggggcgcgagggggggtgggaggggtcagccccgccccccgggcccacgccgggcggtgggggccggggccggggggcggcggcggtgggccgggcctctggcgccggctcgggcggggggctgtccggccagtcgtcgtcatcgtcgtcgtcggacgcggactcgggaacgtggagccactggcgcagcagcagcgaacaagaaggcgggggcccaccggcggggggcggcggcggggcggccgcgggcgcgctcctgaccgcgggttccgagttgggcgtggaggttacctgggactgtgcggttgggacggcgcccgtgggcccgggcggccgggggcggcgggggccgcgatggcggcggcggcgggccatggagacagagagcgtgccggggtggtagagtttgacaggcaagcatgtgcgtgcagaggcgagtagtgcttgcctgtctaactcgctagtctcggccgcggggggcccgggctgcccgccgccgccgctttaaagggccgcgcgcgacccccggggggtgtgttttggggggggcccgttttcggggtctggccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcctccccccgctcccgcggccccgccccccacgcccgccgcgcgcgcgcacgccgcccggaccgccgcccgccttttttgcgcgcgcgcgcgcccgcggggggcccgggctgccacaggtgaaaccaacagagcacggcgcactccgcacgtcacacgtcacgtcatccaccacacctgcccaacaacacaactcacagcgacaactcaccgcgcaacaactcctgttcctcatccacacgtcaccgcgcacctcccgctcctccagacgtaccccggcgcaacacaccgctcctgctacacaccaccgcccctccccagccccagccctccccggccccagccctccccggccccagccctccccggccccagccctccccggccccagccctccccggccccagccctccccggccccagccctccccggccccagccctccccggccgcgtcccgcgctccctcgggggggttcgggcatctctacctcagtgccgccaatctcaggtcagagatccaaaccctccgggggcgcccgcgcaccaccaccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgccccctcccgcccctcgaataaacaacgctactgcaaaacttaatcaggttgttgccgtttattgcgtcttcgggtctcacaagcgccccgccccgtcccggcccgttacagcaccccgtccccctcgaacgcgccgccgtcgtcttcgtcccaggcgccttcccagtccacaacttcccgccgcgggggcgtggccaagcccgcctccgcccccagcacctccacggcccccgccgccgccagcacggtgccgctgcggcccgtggccgaggcccagcgaatcccgggcggcgccggcggcagggcccccgggccgtcgtcgtcgccgcgcagcaccagcgggggggcgtcgtcgtcgggctccagcagggcgcgggcgcaaaagtccctccgcggcccgcgccaccgggccgggccggcgcgcaccgcctcgcgccccagcgccacgtacacgggccgcagcggcgcgcccaggccccagcgcgcgcaggcgcggtgcgagtgggcctcctcctcgcagaagtccggcgcgccgggcgccatggcgtcggtggtccccgaggccgccgcccggccgtccagcgccggcagcacggcccggcggtactcgcgcggggacatgggcaccggcgtgtccgggccgaagcgcgtgcgcacgcggtagcgcacgttgccgccgcggcacaggcgcagcggcggcgcgtcggggtacaggcgcgcgtgcgcggcctccacgcgcgcgaagacccccgggccgaacacgcggcccgaggccagcaccgtgcggcgcaggtcccgcgccgccggccagcgcacggcgcactgcacggcgggcagcagctcgcacgccaggtaggcgtgctgccgcgacaccgcgggcccgtcggcgggccagtcgcaggcgcgcacggtgttgaccacgatgagccgccggtcgccggcgctggcgagcagccccagaaactccacggccccggcgaaggccaggtcccgcgtggacagcagcagcacgccctgtgcgcccagcgccgacacgtcgggggcgccggtccagttgcccgcccaggcggccgtgtccggcccgcacagccggttggccagggccgccagcaggcaggacagcccgccgcgctcggcggaccactccggcggcccccccgaggccccgccgccggccaggtcctcgcccggcagcggcgagtacagcaccaccacgcgcacgtcctcggggtcggggatctggcgcatccaggccgccatgcggcgcagcgggcccgaggcgcgcagggggccaaagaggcggcccccggcggccccgtgggggtgggggttatcgtcgtcgtcgccgccgccgcacgcggcctgggcggcgggggcgggcccggcgcaccgcgcggcgatcgaggccagggcccgcgggtcaaacatgagggccggtcgccaggggacggggaacagcgggtggtccgtgagctcggccacggcgcgcggggagcagtaggcctccagggcggcggccgcgggcgccgccgtgtggctgggccccgggggctgccgccgccagccgcccagggggtcggggccctcggcgggccggcgcgacagcgccacggggcgcgggcgggcctgcgccgcggcggcccggggcgccgcgggctgggcgggggcgggctcgggccccgggggcgtggaggggggcgcgggcgcggggaggggggcgcgggcgtccgagccgggggcgtccgcgccgctcttcttcgtcttcgggggtcgcgggccgccgcctccgggcggccgggccgggccgggactcttgcgcttgcgcccctcccgcggcgcggcggaggcggcggcggccgccagcgcgtcggcggcgtccggtgcgctggccgccgccgccagcagggggcgcaggctctggttgtcaaacagcaggtccgcggcggcggcggccgcggagctcggcaggcgcgggtcccgcggcagcgcggggcccagggccccggcgaccaggctcacggcgcgcacggcggccacggcggcctcgctgccgccggccacgcgcaggtccccgcgcaggcgcatgagcaccagcgcgtcgcgcacgaaccgcagctcgcgcagccacgcgcgcaggcggggcgcgtcggcgtgcggcggcggcggggaagcggggcccgcgggtccctccggccgcggggggctggcgggccgggccccggccagccccgggacggccgccaggtcgccgtcgaagccctcggccagcgcctccaggatcccgcggcaggcggccaggcactcgacggccacgcggccggcctgggcgcggcgcccggcgtcgtcgtcggcgtcggcgtggcgggcggcgtcggggtcgtcgccccccgcgggggaggcgggcgcggcggacagccgccccagggcggcgaggatccccgcggcgccgtacccggcgggcaccgcgcgctcgcccggtgcggcggcggcgacggcggcgaccccctcgtcatctgcgccggcgccggggctccccgcggcccccgtcagcgccgcgttctcgcgcgccaacaggggcgcgtaggcgcggcgcaggctggtcagcaggaagcccttctgcgcgcggtcgtatcggcggctcatggccacggcggccgccgcgtgcgccaggccccagccgaagcggccggccgccatggcgtagcccaggtggggcacggcccgcgccacgctgccggtgatgaaggagctgctgttgcgcgcggcgcccgagatccggaagcaggcctggtccagcgccacgtccccggggaccacgcgcgggttctggagccaccccatggcctccgcgtccggggtgtacagcagccgcgtgatcagggcgtactgctgcgcggcgtcgcccagctcgggcgcccacacggccgccggggcgcccgaggcctcgaaccggcgtcgcgcctcctccgcctcgggcgccccccagaggcccgggcggctgtcgcccaggccgccgtacagcacccgccccgggggcgggggcccggcgccgggccacggctccccgctgacgtacccgtcgcgatagcgcgcgtagaaggcgccggaggccgcgtcggcgtccagctcgacccgccggggctgcccggccgtgaagcggcccgtggcgtcgcggccggccaccgccgcgcgggcccggcggcgctcgatgcggcccgcggaggccgcgggggtcctcgccgccgcccggggcttgggcgcggcctcggagagggggggtggcccgggcgggggcggcgtccgcccgggggctgccggcgccgcgctcgacggaccccgcccgacggcccgcgcctcgcgtgcgtggtcggccgcgtcgttgccgtcgtcgtcctcgtcctcgtcggacgacgaggacgaagaggatgcggacgacgaggacgaggacccggagtccgacgaggtcgatgacgccgatggccgccaccggccgtgacgacgtctccgcggcggctgggccggcgggcgcggcgacaggcggtccgtggggtccggatacgcgccgcgtagcggggcctcccgttcgcggccccgggccggggcccggtcgccggcggcgtcggctgcgtcgtcgtactcgtccccgtcatcgtcgtcggctcgaaaggcgggggtccggggcggcgaggccgcggggtcgggcgtcgggatcgtccggacggcctcctctaccatggaggccagcagagccagctgtcgcggcgagacggcgtccccggcgtcctcgccggcgtcggtgcccgccgcgggggccctcccgtcccgccgggcgtcgtcgaggtcgtgggggtggtcggggtcgtggtcggggtcgtccccgccctcctccgtctccgcgccccacccgagggccccccgctcgtcgcggtctgggctcggggtgggcggcggcccgtcggtggggcccggggagccggggcgctgcttgttctccgacgccatcgccgatgcggggcgatcctccggggatacggctgcgacggcggacgtagcacggtaggtcacctacggactctcgatggggggagggggcgagacccacggaccccgacgacccccgccgtcgacgcggaactagcgcggaccggtcgatgcttgggtgggaaaaaggacagggacggccgatccccctcccgcgcttcgtccgcgtatcggcgtcccggcgcggcgagcgtctgacggtctgtctctggcggtcccgcgtcgggtcgtggatccgtgtcggcagccgcgctccgtgtggacgatcggggcgtcctcgggctcatatagtcccaggggccggcgggaaggaggagcagcggaggccgccggccccccgcccccccggcgggcccaccccgaacggaattccattatgcacgaccccgccccgacgccggcacgccgggggcccgtggccgcggcccgttggtcgaacccccggccccgcccatccgcgccatctgccatgggcggggcgcgagggcgggtgggtccgcgccccgccccgcatggcatctcattaccgcccgatccggcggtttccgcttccgttccgcatgctaacgaggaacgggcagggggcggggcccgggccccgacttcccggttcggcggtaatgagatacgagccccgcgcgcccgttggccgtccccgggccccccggtcccgcccgccggacgccgggaccaacgggacggcgggcggcccaagggccgcccgccttgccgcccccccattggccggcgggcgggaccgccccaagggggcggggccgccgggtaaaagaagtgagaacgcgaagcgttcgcacttcgtcccaatatatatatattattagggcgaagtgcgagcactggcgccgtgcccgactccgcgccggccccgggggcgggcccgggcggcggggggcgggtctctccggcgcacataaaggcccggcgcgaccgacgcccgcagacggcgccggccacgaacgacgggagcggctgcggagcacgcggaccgggagcgggagtcgcagagggccgtcggagcggacggcgtcggcatcgcgacgccccggctcgggatcgggatcgcatcggaaagggacacgcggacgcgggggggaaagacccgcccaccccacccacgaaacacaggggacgcaccccgggggcctccgacgacagaaacccaccggtccgccttttttgcacgggtaagcaccttgggtgggcggaggagggggggacgcgggggcggaggaggggggacgcgggggcggaggaggggggacgcgggggcggaggaggggggacgcgggggcggaggaggggggacgcgggggcggaggagggggctcacccgcgttcgtgccttcccgcaggaggaacgtcctcgtcgaggcgaccggcggcgaccgttgcgtggaccgcttcctgctcgtcgggcggggggaagccactgtggtcctccgggacgttttctggatggccgacatttccccaggcgcttttgcgccttgtgtaaaagcgcggcgtcccgctctccgatccccgcccctgggcacgcgcaagcgcaagcgcccttcccgccccctctcatcggagtctgaggtagaatccgatacagccttggagtctgaggtcgaatccgagacagcatcggattcgaccgagtctggggaccaggatgaagccccccgcatcggtggccgtagggccccccggaggcttggggggcggttttttctggacatgtcggcggaatccaccacggggacggaaacggatgcgtcggtgtcggacgaccccgacgacacgtccgactggtcttatgacgacattcccccacgacccaagcgggcccgggtaaacctgcggctcacgagctctcccgatcggcgggatggggttatttttcctaagatggggcgggtccggtctacccgggaaacgcagccccgggcccccaccccgtcggccccaagcccaaatgcaatgctacggcgctcggtgcgccaggcccagaggcggagcagcgcacgatggacccccgacctgggctacatgcgccagtgtatcaatcagctgtttcgggtcctgcgggtcgcccgggacccccacggcagtgccaaccgcctgcgccacctgatacgcgactgttacctgatgggatactgccgagcccgtctggccccgcgcacgtggtgccgtttgctgcaggtgtccggcggaacctggggcatgcacctgcgcaacaccatacgggaggtggaggctcgattcgacgccaccgcggaacccgtgtgcaagcttccttgtttggagaccagacggtacggcccggagtgtgatcttagtaatctcgagattcatctcagcgcgacaagcgatgatgaaatctccgatgccaccgatctggaggccgccggttcggaccacacgctcgcgtcccagtccgacacggaggatgccccctcccccgttacgctggaaaccccagaaccccgcgggtccctcgctgtgcgtctggaggatgagtttggggagtttgactggaccccccaggagggctcccagccctggctgtctgcggtcgtggccgataccagctccgtggaacgcccgggcccatccgattctggggcgggtcgcgccgcagaagaccgcaagtgtctggacggctgccggaaaatgcgcttctccaccgcctgcccctatccgtgcagcgacacgtttctccggccgtgagtccggtcgccccgacccccttgtatgtccccaaaataaaagaccaaaatcaaagcgtttgtcccagcgtcttaatggcgggaagggcggagagaaacagaccacgcggacatggggggtgtttgggggtttattggcaccgggggctaaagggtggtaaccggatagcagatgtgaggaagtcggggccgttcgccgcgaacggcgatcagagggtcagtttcttgcggaccacggcccggcgatgtgggttgctcgtctgggacctcgggcatgcccatacacgcacaacacggacgccgcaccggatgggacgtcgtaagggggcctggggtagctgggtggggtttgtgcagagcaatcagggaccgcagccagcgcatacaatcgcgctcccgtccgtttgtcccgggcagtaccacgccgtactggtattcgtaccggctgagcagggtctccagggggtggttgggggccgcggggaacggggtccacgccacggtccactcgggcaaaaaccgagtcggcacggcccacggttctcccacccacgcgtctggggtcttgatggcgataaatcttaccccgagccggattttttgggcgtattcgagaaacggcacacacagatccgccgcgcctaccacccacaagtggtagaggcgaggggggctgggttggtctcggtgcagcagtcggaagcacgccacggcgtccacgacctcggtgctctccaaggggctgtcctccgcaaacaggcccgtggtggtgtttggggggcagcgacaggacctagtgcgcacgatcgggcgggtgggtttgggtaagtccatcagcggctcggccaaccgtcgaaggttggccggacgaacgacgaccggggtacccaggggttctgatgccaaaatgcggcactgcctaagcaggaagctccacagggccgggcttgcgtcgacggaagtccggggcagggcgttgttctggtcaaggagggtcattacgttgacgacaacaacgcccatgttggtatattacaggcccgtgtccgatttggggcacttgcagatttgtaaggccacgcacggcggggagacaggccgacgcgggggctgctctaaaaatttaagggccctacggtccacagacccgccttcccgggggggcccttggagcgaccggcagcggaggcgtccgggggaggggagggtgatttacgggggggtaggtcagggggtgggtcgtcaaactgccgctccttaaaaccccggggcccgtcgttcggggtgctcgttggttggcactcacggtgcggcgaatggcctgtcgtaagttttgtcgcgtttacgggggacagggcaggaggaaggaggaggccgtcccgccggagacaaagccgtcccgggtgtttcctcatggccccttttataccccagccgaggacgcgtgcctggactccccgcccccggagacccccaaaccttcccacaccacaccacccagcgaggccgagcgcctgtgtcatctgcaggagatccttgcccagatgtacggaaaccaggactaccccatagaggacgaccccagcgcggatgccgcggacgatgtcgacgaggacgccccggacgacgtggcctatccggaggaatacgcagaggagctttttctgcccggggacgcgaccggtccccttatcggggccaacgaccacatccctcccccgtgtggcgcatctccccccggtatacgacgacgcagccgggatgagattggggccacgggatttaccgcggaagagctggacgccatggacagggaggcggctcgagccatcagccgcggcggcaagcccccctcgaccatggccaagctggtgactggcatgggctttacgatccacggagcgctcaccccaggatcggaggggtgtgtctttgacagcagccatccagattacccccaacgggtaatcgtgaaggcggggtggtacacgagcacgagccacgaggcgcgactgctgaggcgactggaccacccggcgatcctgcccctcctggacctgcatgtcgtctccggggtcacgtgtctggtcctccccaagtaccaggccgacctgtatacctatctgagtaggcgcctgaacccactgggacgcccgcagatcgcagcggtctcccggcagctcctaagcgccgttgactacattcaccgccagggcattatccaccgcgacattaagaccgaaaatatttttattaacacccccgaggacatttgcctgggggactttggcgccgcgtgcttcgtgcagggttcccgatcaagccccttcccctacggaatcgccggaaccatcgacaccaacgcccccgaggtcctggccggggatccgtataccacgaccgtcgacatttggagcgccggtctggtgatcttcgagactgccgtccacaacgcgtccttgttctcggccccccgcggccccaaaaggggcccgtgcgacagtcagatcacccgcatcatccgacaggcccaggtccacgttgacgagttttccccgcatccagaatcgcgcctcacctcgcgctaccgctcccgcgcggccgggaacaatcgcccgccgtacacccgaccggcctggacccgctactacaagatggacatagacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtagggtatggggcgggggatggggagagcccacatgcggaaagcaagaacaataaaggcggtggtatctagttgatatgcatctctgggtgtttttggggtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggccaacacaacggaccccttaacgcacgccccagtgtcccctcaccccagccccctggggggctttgccgtccccctcgtagtcggtgggctgtgcgccgtagtcctgggggcggcatgtctgcttgagctcctgcgtcgtacgtgccgcgggtgggggcgttaccatccctacatggacccagttgtcgtataatttcccccccccccccccttctccgcgtgggtgatgtcgggtccaaactcccgacaccaccagctggcatggtataaatcaccggtgcgccccccaaaccatgtccggcagggggatgggggggcgaatgcggagggcacccaacaacaccgggctaaccaggaaatccgtggccccggcccccaataaagatcgcggtagcccggccgtgtgacactatcgtccataccgaccacaccgacgaatcccccaagggggaggggccattttacgaggaggaggggtataacaaagtctgtctttaaaaagcaggggttagggagttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcggcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactagatacccccccttaatgggtgcgggggggtcaggtctgcggggttgggatgggaccttaactccatataaagcgagtctggaaggggggaaaggtggacagtcgataagtcggtagcgggggacgcgcacctgttccgcctgtcgcacccacagctttttttgcgaaccgtcccgttccgggatgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtataggtccacggccactggccgggagcaccacataaccgaccgcagtccctgagttgggaataaaccggtattatttacctatatccgtgtatgtcgatttctttccccccctccccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaaggcgccccatcccgaggccccacgtcggtcgccgaactgggcgaccgccggcgaggtggacgtcggagacgagctaatcgcgatttccgacgaacgcggacccccccgacatgaccgcccgcccctcgccacgtcgaccgcgccctcgccacacccgcgacccccgggctacacggccgttgtctccccgatggccctccaggctgtcgacgccccctccctgtttgtcgcctggctggccgctcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgatgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaaaagaccgcatcgacacgcgcgtccttcttgtcgtctctcttcccccccatcaccccgcaatttgcacccagcctttaactacattaaattgggttcgattggcaatgttgtctcccggttgatttttgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtgggtgggtggggagtggcaaggaagaaacaagcccgaccaccagacagaaaatgtaaccatacccaaaccgactctgggggctgtttgtggggtcggaaccataggatgaacaaaccaccccgtaccacccgcacccaagggtgcgggtggctcatcggcatctgtccggtatgggttgttccccacccactcgcgttcggacgtcttagaatcatggcggttttctatgccgacatcggttttctcccccgcaataagacacgatgcgataaaatctgtttgtaaaatttattaagggtacaaattgccctagcacaggggtggggttagggccgggtccccacacccaaacgcaccaaacagatgcaggcagtgggtcgagtacagccccgcgtacgaacacgtcgatgcgtgtgtcagacagcaccagaaagcacaggccatcaacaggtcgtgcatgtgtcggtgggtttggacgcggggggccatggtggtgataaagttaatggccgccgtccgccagggccacaggggcgacgtctcttggttggcccggagccactgggtgtggaccagccgcgcgtggcggcccaacatggcccctgtagccgggggcgggggatcgcgcacgtttgcagcgcacatgcgagacacctcgaccacggttcgaaagaaggcccggtggtccgcgggcaacatcaccaggtgcgcaagcgcccgggcgtccagagggtagagccctgagtcatccgaggttggctcatcgcccgggtcttgccgcaagtgcgtgtgggttgggcttccggtgggcgggacgcgaaccgcggtgtggatcccgacgcgggcccgagcgtatgctccatgttgtggggagaaggggtctgggctcgccaggggggcatacttgcccgggctatacagacccgcgagccgtacgtggttcgcggggggtgcgtggggtccggggctcccggggagaccggggctcccggggagaccggggctccctgggagaccggggttgtcgtggatccctggggtcacgcggtaccctggggtctctgggagctcgcggtactctgggttccctaggttctcggggtggtcgcggaacccggggctcccggggaacacgcggtgtcctggggattgttggcggtcggacggcttcagatggcttcgagatcgtagtgtccgcaccgactcgtagtagacccgaatctccacattgccccgccgcttgatcattatcaccccgttgcgggggtccggagatcatgcgcgggtgtcctcgaggtgcgtgaacacctctggggtgcatgccggcggacggcacgccttttaagtaaacatctgggtcgcccggcccaactggggccgggggttgggtctggctcatctcgagagccacgggggggaaccaccctccgcccagagactcgggtgatggtcgtacccgggactcaacgggttaccggattacggggactgtcggtcacggtcccgccggttcttcgatgtgccacacccaaggatgcgttgggggcgatttcgggcagcagcccgggagagcgcagcaggggacgctccgggtcgtgcacggcggttctggccgcctcccggtcctcacgcccccttttattgatctcatcgctcccccccgacgagcaggaagcggtccacgcaacggtcgccgccggtcgcctcgacgaggacgttcctcctgcgggaaggcacgaacgcgggtgagccccctcctccgcccccgcgtcccccctcctccgcccccgcgtcccccctcctccgcccccgcgtcccccctcctccgcccccgcgtcccccctcctccgcccccgcgtccccccctcctccgcccacccaaggtgcttacccgtgcaaaaaaggcggaccggtgggtttctgtcgtcggaggcccccggggtgcgtcccctgtgtttcgtgggtggggtgggcgggtctttcccccccgcgtccgcgtgtccctttccgatgcgatcccgatcccgagccggggcgtcgcgatgccgacgccgtccgctccgacggccctctgcgactcccgctcccggtccgcgtgctccgcagccgctcccgtcgttcgtggccggcgccgtctgcgggcgtcggtcgcgccgggcctttatgtgcgccggagagacccgccccccgccgcccgggcccgcccccggggccggcgcggagtcgggcacggcgccagtgctcgcacttcgccctaataatatatatatattgggacgaagtgcgaacgcttcgcgttctcacttcttttacccggcggccccgcccccttggggcggtcccgcccgccggccaatgggggggcggcaaggcgggcggcccttgggccgcccgccgtcccgttggtcccggcgtccggcgggcgggaccggggggcccggggacggccaacgggcgcgcggggctcgtatctcattaccgccgaaccgggaagtcggggcccgggccccgccccctgcccgttcctcgttagcatgcggaacggaagcggaaaccgccggatcgggcggtaatgagatgccatgcggggcggggcgcggacccacccgccctcgcgccccgcccatggcagatggcgcggatgggcggggccgggggttcgaccaacgggccgcggccacgggcccccggcgtgccggcgtcggggcggggtcgtgcataatggaattccgttcggggtgggcccgccgggggggcggggggccggcggcctccgctgctcctccttcccgccggcccctgggactatatgagcccgaggacgccccgatcgtccacacggagcgcggctgccgacacggatccacgacccgacgcgggaccgccagagacagaccgtcagacgctcgccgcgccgggacgccgatacgcggacgaagcgcgggagggggatcggccgtccctgtcctttttcccacccaagcatcgaccggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgatggcgtcggagaacaagcagcgccccggctccccgggccccaccgacgggccgccgcccaccccgagcccagaccgcgacgagcggggggccctcgggtggggcgcggagacggaggagggcggggacgaccccgaccacgaccccgaccacccccacgacctcgacgacgcccggcgggacgggagggcccccgcggcgggcaccgacgccggcgaggacgccggggacgccgtctcgccgcgacagctggctctgctggcctccatggtagaggaggccgtccggacgatcccgacgcccgaccccgcggcctcgccgccccggacccccgcctttcgagccgacgacgatgacggggacgagtacgacgacgcagccgacgccgccggcgaccgggccccggcccggggccgcgaacgggaggccccgctacgcggcgcgtatccggaccccacggaccgcctgtcgccgcgcccgccggcccagccgccgcggagacgtcgtcacggccggtggcggccatcggcgtcatcgacctcgtcggactccgggtcctcgtcctcgtcgtccgcatcctcttcgtcctcgtcgtccgacgaggacgaggacgacgacggcaacgacgcggccgaccacgcacgcgaggcgcgggccgtcgggcggggtccgtcgagcgcggcgccggcagcccccgggcggacgccgcccccgcccgggccaccccccctctccgaggccgcgcccaagccccgggcggcggcgaggacccccgcggcctccgcgggccgcatcgagcgccgccgggcccgcgcggcggtggccggccgcgacgccacgggccgcttcacggccgggcagccccggcgggtcgagctggacgccgacgcggcctccggcgccttctacgcgcgctatcgcgacgggtacgtcagcggggagccgtggcccggcgccgggcccccgcccccggggcgggtgctgtacggcggcctgggcgacagccgcccgggcctctggggggcgcccgaggcggaggaggcgcgacgccggttcgaggcctcgggcgccccggcggccgtgtgggcgcccgagctgggcgacgccgcgcagcagtacgccctgatcacgcggctgctgtacaccccggacgcggaggccatggggtggctccagaacccgcgcgtggtccccggggacgtggcgctggaccaggcctgcttccggatctcgggcgccgcgcgcaacagcagctccttcatcaccggcagcgtggcgcgggccgtgccccacctgggctacgccatggcggccggccgcttcggctggggcctggcgcacgcggcggccgccgtggccatgagccgccgatacgaccgcgcgcagaagggcttcctgctgaccagcctgcgccgcgcctacgcgcccctgttggcgcgcgagaacgcggcgctgacgggggccgcggggagccccggcgccggcgcagatgacgagggggtcgccgccgtcgccgccgccgcaccgggcgagcgcgcggtgcccgccgggtacggcgccgcggggatcctcgccgccctggggcggctgtccgccgcgcccgcctcccccgcggggggcgacgaccccgacgccgcccgccacgccgacgccgacgacgacgccgggcgccgcgcccaggccggccgcgtggccgtcgagtgcctggccgcctgccgcgggatcctggaggcgctggccgagggcttcgacggcgacctggcggccgtcccggggctggccggggcccggcccgccagccccccgcggccggagggacccgcgggccccgcttccccgccgccgccgcacgccgacgcgccccgcctgcgcgcgtggctgcgcgagctgcggttcgtgcgcgacgcgctggtgctcatgcgcctgcgcggggacctgcgcgtggccggcggcagcgaggccgccgtggccgccgtgcgcgccgtgagcctggtcgccggggccctgggccccgcgctgccgcgggacccgcgcctgccgagctccgcggccgccgccgccgcggacctgctgtttgacaaccagagcctgcgccccctgctggcggcggcggccagcgcaccggacgccgccgacgcgctggcggccgccgccgcctccgccgcgccgcgggaggggcgcaagcgcaagagtcccggcccggcccggccgcccggaggcggcggcccgcgacccccgaagacgaagaagagcggcgcggacgcccccggctcggacgcccgcgcccccctccccgcgcccgcgcccccctccacgcccccggggcccgagcccgcccccgcccagcccgcggcgccccgggccgccgcggcgcaggcccgcccgcgccccgtggcgctgtcgcgccggcccgccgagggccccgaccccctgggcggctggcggcggcagcccccggggcccagccacacggcggcgcccgcggccgccgccctggaggcctactgctccccgcgcgccgtggccgagctcacggaccacccgctgttccccgtcccctggcgaccggccctcatgtttgacccgcgggccctggcctcgatcgccgcgcggtgcgccgggcccgcccccgccgcccaggccgcgtgcggcggcggcgacgacgacgataacccccacccccacggggccgccgggggccgcctctttggccccctgcgcgcctcgggcccgctgcgccgcatggcggcctggatgcgccagatccccgaccccgaggacgtgcgcgtggtggtgctgtactcgccgctgccgggcgaggacctggccggcggcggggcctcgggggggccgccggagtggtccgccgagcgcggcgggctgtcctgcctgctggcggccctggccaaccggctgtgcgggccggacacggccgcctgggcgggcaactggaccggcgcccccgacgtgtcggcgctgggcgcacagggcgtgctgctgctgtccacgcgggacctggccttcgccggggccgtggagtttctggggctgctcgccagcgccggcgaccggcggctcatcgtggtcaacaccgtgcgcgcctgcgactggcccgccgacgggcccgcggtgtcgcggcagcacgcctacctggcgtgcgagctgctgcccgccgtgcagtgcgccgtgcgctggccggcggcgcgggacctgcgccgcacggtgctggcctcgggccgcgtgttcggcccgggggtcttcgcgcgcgtggaggccgcgcacgcgcgcctgtaccccgacgcgccgccgctgcgcctgtgccgcggcggcaacgtgcgctaccgcgtgcgcacgcgcttcggcccggacacgccggtgcccatgtccccgcgcgagtaccgccgggccgtgctgccggcgctggacggccgggcggcggcctcggggaccaccgacgccatggcgcccggcgcgccggacttctgcgaggaggaggcccactcgcaccgcgcctgcgcgcgctggggcctgggcgcgccgctgcggcccgtgtacgtggcgctggggcgcgaggcggtgcgcgccggcccggcccggtggcgcgggccgcggagggacttttgcgcccgcgccctgctggagcccgacgacgacgcccccccgctggtgctgcgcggcgacgacgacggcccgggggccctgccgccggcgccgcccgggattcgctgggcctcggccacgggccgcagcggcaccgtgctggcggcggcgggggccgtggaggtgctgggggcggaggcgggcttggccacgcccccgcggcgggaagttgtggactgggaaggcgcctgggacgaagacgacggcggcgcgttcgagggggacggggtgctgtaacgggccgggacggggcggggcgcttgtgagacccgaagacgcaataaacggcaacaacctgattaagttttgcagtagcgttgtttattcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcgggagggggcgaggggcggtggtggtgcgcgggcgcccccggagggtttggatctctgacctgagattggcggcactgaggtagagatgcccgaacccccccgagggagcgcgggacgcggccggggagggctggggccggggagggctggggccggggagggctggggccggggagggctggggccggggagggctggggccggggagggctggggccggggagggctggggccggggagggctggggctggggaggggcggtggtgtgtagcaggagcggtgtgttgcgccggggtacgtctggaggagcgggaggtgcgcggtgacgtgtggatgaggaacaggagttgttgcgcggtgagttgtcgctgtgagttgtgttgttgggcaggtgtggtggatgacgtgacgtgtgacgtgcggagtgcgccgtgctctgttggtttcacctgtggcagcccgggccccccgcgggcgcgcgcgcgcgcaaaaaaggcgggcggcggtccgggcggcgtgcgcgcgcgcggcgggcgtggggggcggggccgcgggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggggggaggagcggccagaccccgaaaacgggccccccccaaaacacaccccccgggggtcgcgcgcggccctttaaagcggcggcggcgggc

SEQ ID NO: 25 - protein, 775 aa, Herpes simplex virus 1
MEPRPGASTRRPEGRPQREPAPDVWVFPCDRDLPDSSDSEAETEVGGRGDADHHDDDSASEADSTDTELFETGLLGPQGVDGGAVSGGSPPREEDPGSCGGAPPREDGGSDEGDVCAVCTDEIAPHLRCDTFPCMHRFCIPCMKTWMQLRNTCPLCNAKLVYLIVGVTPSGSFSTIPIVNDPQTRMEAEEAVRAGTAVDFIWTGNQRFAPRYLTLGGHTVRALSPTHPEPTTDEDDDDLDDADYVPPAPRRTPRAPPRRGAAAPPVTGGASHAAPQPAAARTAPPSAPIGPHGSSNTNTTTNSSGGGGSRQSRAAAPRGASGPSGGVGVGVGVVEAEAGRPRGRTGPLVNRPAPLANNRDPIVISDSPPASPHRPPAAPMPGSAPRPGPPASAAASGPARPRAAVAPCVRAPPPGPGPRAPAPGAEPAARPADARRVPQSHSSLAQAANQEQSLCRARATVARGSGGPGVEGGHGPSRGAAPSGAAPLPSAASVEQEAAVRPRKRRGSGQENPSPQSTRPPLAPAGAKRAATHPPSDSGPGGRGQGGPGTPLTSSAASASSSSASSSSAPTPAGAASSAAGAASSSASASSGGAVGALGGRQEETSLGPRAASGPRGPRKCARKTRHAETSGAVPAGGLTRYLPISGVSSVVALSPYVNKTITGDCLPILDMETGNIGAYVVLVDQTGNMATRLRAAVPGWSRRTLLPETAGNHVMPPEYPTAPASEWNSLWMTPVGNMLFDQGTLVGALDFRSLRSRHPWSGEQGASTRDEGKQ

SEQ ID NO: 26 - protein, 511 aa, Herpes simplex virus 1
MAPGRVGLAVVLWSLLWLGAGVSGGSETASTGPTITAGAVTNASEAPTSGSPGSAASPEVTPTSTPNPNNVTQNKTTPTEPASPPTTPKPTSTPKSPPTSTPDPKPKNNTTPAKSGRPTKPPGPVWCDRRDPLARYGSRVQIRCRFRNSTRMEFRLQIWRYSMGPSPPIAPAPDLEEVLTNITAPPGGLLVYDSAPNLTDPHVLWAEGAGPGADPPLYSVTGPLPTQRLIIGEVTPATQGMYYLAWGRMDSPHEYGTWVRVRMFRPPSLTLQPHAVMEGQPFKATCTAAAYYPRNPVEFVWFEDDHQVFNPGQIDTQTHEHPDGFTTVSTVTSEAVGGQVPPRTFTCQMTWHRDSVTFSRRNATGLALVLPRPTITMEFGVRIVVCTAGCVPEGVTFAWFLGDDPSPAAKSAVTAQESCDHPGLATVRSTLPISYDYSEYICRLTGYPAGIPVLEHHGSHQPPPRDPTERQVIEAIEWVGIGIGVLAAGVLVVTAIVYVVRTSQSRQRHRR

SEQ ID NO: 27 - DNA, 1536 bp, Herpes simplex virus 1
atggccccggggcgggtgggccttgccgtggtcctgtggagcctgttgtggctcggggcgggggtgtccgggggctcggaaactgcctccaccgggcccacgatcaccgcgggagcggtgacgaacgcgagcgaggcccccacatcggggtcccccgggtcagccgccagcccggaggtcacccccacatcgaccccaaaccccaacaatgtcacacaaaacaaaaccacccccaccgagccggccagccccccaacaacccccaagcccacctccacgcccaaaagcccccccacgtccacccccgaccccaaacccaagaacaacaccacccccgccaagtcgggccgccccactaaaccccccgggcccgtgtggtgcgaccgccgcgacccattggcccggtacggctcgcgggtgcagatccgatgccggtttcggaattccacccgcatggagttccgcctccagatatggcgttactccatgggtccgtcccccccaatcgctccggctcccgacctagaggaggtcctgacgaacatcaccgccccacccgggggactcctggtgtacgacagcgcccccaacctaacggacccccacgtgctctgggcggagggggccggcccgggcgccgaccctccgttgtattctgtcaccgggccgctgccgacccagcggctgattatcggcgaggtgacgcccgcgacccagggaatgtattacttggcctggggccggatggacagcccgcacgagtacgggacgtgggtgcgcgtccgcatgttccgccccccgtctctgaccctccagccccacgcggtgatggagggtcagccgttcaaggcgacgtgcacggccgccgcctactacccgcgtaaccccgtggagtttgtctggttcgaggacgaccaccaggtgtttaacccgggccagatcgacacgcagacgcacgagcaccccgacgggttcaccacagtctctaccgtgacctccgaggctgtcggcggccaggtccccccgcggaccttcacctgccagatgacgtggcatcgcgactccgtgacgttctcgcgacgcaatgccaccgggctggccctggtgctgccgcggccaaccatcaccatggaatttggggtccgcattgtggtctgcacggccggctgcgtccccgagggcgtgacgtttgcctggttcctgggggacgacccctcaccggcggctaagtcggccgttacggcccaggagtcgtgcgaccaccccgggctggctacggtccggtccaccctgcccatttcgtacgactacagcgagtacatctgtcggttgaccggatatccggccgggattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaa

The invention claimed is:

1. A method of treating an alternative lengthening of telomeres (ALT)-dependent cancer in a subject, comprising:
   selecting a subject having an ALT-dependent cancer; and
   administering to the subject a recombinant herpes simplex virus (HSV)-1 that is infected cell protein 0 (ICP0)-deficient, glycoprotein C (gC)-deficient, or both ICP0-deficient and gC-deficient, thereby treating the ALT-dependent cancer in the subject.

2. The method of claim 1, wherein the recombinant HSV-1 comprises a disruption in at least one copy of the ICP0 gene that diminishes or eliminates expression of functional ICP0.

3. The method of claim 2, wherein:
   the disruption in the ICP0 gene is a complete deletion of the ICP0 gene;
   the disruption in the ICP0 gene is a partial deletion in the ICP0 gene; or
   the disruption in the ICP0 gene is an insertion or a point mutation in the ICP0 gene.

4. The method of claim 3, wherein the partial deletion in the ICP0 gene or the insertion or point mutation in the ICP0 gene is in the RING finger domain coding region, wherein the RING finger domain corresponds to amino acids 116-157 of SEQ ID NO: 25.

5. The method of claim 1, wherein the recombinant HSV-1 comprises a gC gene with a deletion of the cytosine at position 186 relative to the gC gene of wild-type HSV-1, wherein the gC gene of wild-type HSV-1 comprises the nucleotide sequence of SEQ ID NO: 27.

6. The method of claim 1, wherein the recombinant HSV-1 comprises a gC gene with a premature termination at the 175$^{th}$ codon relative to the gC gene of wild-type HSV-1, wherein the gC gene of wild-type HSV-1 comprises the nucleotide sequence of SEQ ID NO: 27.

7. The method of claim 1, wherein the recombinant HSV-1 further comprises a heterologous gene encoding an immunostimulatory molecule.

8. The method of claim 1, wherein the recombinant HSV-1 further comprises a disruption in at least one copy of the ICP34.5 gene, the ICP6 gene, and/or the ICP47 gene that diminishes or eliminates expression of functional ICP34.5, ICP6 and/or ICP47.

9. The method of claim 8, wherein:
   the disruption in the ICP34.5 gene, the ICP6 gene, or the ICP47 gene is a complete deletion of the ICP34.5 gene, the ICP6 gene, or the ICP47 gene;
   the disruption in the ICP34.5 gene, the ICP6 gene, or the ICP47 gene is a partial deletion in the ICP34.5 gene, the ICP6 gene, or the ICP47 gene; or
   the disruption in the ICP34.5 gene, the ICP6 gene, or the ICP47 gene is an insertion or a point mutation in the ICP34.5 gene, the ICP6 gene, or the ICP47 gene.

10. The method of claim 1, wherein the recombinant HSV-1 comprises a complete deletion of the ICP0 gene and comprises a heterologous gene encoding GM-CSF.

11. The method of claim 10, wherein the recombinant HSV-1 comprises a genome sequence at least 80% identical to SEQ ID NO: 15 or SEQ ID NO: 23.

12. The method of claim 1, wherein the recombinant HSV-1 comprises a complete deletion of the ICP0 gene and a partial deletion of the ICP47 gene, and further comprises a heterologous gene encoding GM-CSF.

13. The method of claim 12, wherein the recombinant HSV-1 comprises a genome sequence at least 80% identical to SEQ ID NO: 16 or SEQ ID NO: 24.

14. The method of claim 1, further comprising administering an anti-cancer therapy to the subject.

15. The method of claim 1, wherein the ALT-dependent cancer is a soft tissue sarcoma, a cancer of the central nervous system, or an osteosarcoma.

* * * * *